United States Patent
Brandon et al.

(10) Patent No.: US 10,167,511 B2
(45) Date of Patent: Jan. 1, 2019

(54) BIOMARKER IDENTIFICATION

(71) Applicant: ImmuneXpress Pty Ltd, Boonah (AU)

(72) Inventors: Richard Bruce Brandon, Boonah (AU); Leo Charles McHugh, Seattle, WA (US)

(73) Assignee: IMMUNEXPRESS PTY LTD, Toowong (AU)

( * ) Notice: Subject to any disclaimer, the term of this patent is extended or adjusted under 35 U.S.C. 154(b) by 0 days.

(21) Appl. No.: 15/201,431

(22) Filed: Jul. 2, 2016

(65) Prior Publication Data

US 2016/0312286 A1 Oct. 27, 2016

Related U.S. Application Data

(63) Continuation of application No. 14/714,182, filed on May 15, 2015, now abandoned, which is a continuation of application No. PCT/AU2014/050075, filed on Jun. 18, 2014.

(51) Int. Cl.

| C07H 21/00 | (2006.01) |
| C12Q 1/6883 | (2018.01) |
| C12Q 1/689 | (2018.01) |
| G06F 19/20 | (2011.01) |

(52) U.S. Cl.
CPC .......... *C12Q 1/6883* (2013.01); *C12Q 1/689* (2013.01); *G06F 19/20* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| 2003/0219760 A1 | 11/2003 | Gordon et al. |
| 2004/0096917 A1 | 5/2004 | Ivey et al. |
| 2004/0097460 A1 | 5/2004 | Ivey et al. |
| 2006/0019256 A1 | 1/2006 | Clarke et al. |
| 2006/0246495 A1 | 11/2006 | Garrett et al. |
| 2007/0105133 A1 | 5/2007 | Clarke et al. |
| 2007/0134261 A1 | 6/2007 | Hancock et al. |
| 2007/0154931 A1 | 7/2007 | Radich et al. |
| 2008/0070235 A1 | 3/2008 | Russwurm et al. |
| 2008/0286763 A1 | 11/2008 | Russwurm et al. |
| 2009/0203534 A1 | 8/2009 | Hossain et al. |
| 2010/0028876 A1 | 2/2010 | Gordon et al. |
| 2011/0076685 A1 | 3/2011 | Moeller et al. |
| 2011/0098195 A1 | 4/2011 | Russwurm |
| 2011/0312521 A1 | 12/2011 | Chaussabel |
| 2012/0082659 A1 | 4/2012 | Land et al. |
| 2014/0037649 A1 | 2/2014 | Brandon et al. |
| 2015/0218640 A1 | 8/2015 | Brandon et al. |
| 2016/0055295 A1 | 2/2016 | Brandon et al. |
| 2016/0237493 A1 | 8/2016 | Brandon et al. |
| 2017/0191129 A1 | 7/2017 | Brandon et al. |

FOREIGN PATENT DOCUMENTS

| WO | WO 1999/045398 A1 | 9/1999 |
| WO | WO 2006/042192 A2 | 4/2006 |
| WO | WO 2007/060647 A2 | 5/2007 |
| WO | 2007130831 A2 | 11/2007 |
| WO | WO 2010/083252 A2 | 7/2010 |
| WO | WO 2011/003905 A1 | 1/2011 |
| WO | WO 2012/068642 A1 | 5/2012 |
| WO | WO 2013/040379 A1 | 3/2013 |
| WO | WO 2014/201516 A2 | 4/2014 |
| WO | WO 2015/117204 A1 | 8/2015 |

OTHER PUBLICATIONS

Fu et al. BMC Genomics. 2008. 9:369.*
Sivapalaratnam et al. BMC Medical Genomics. 2011. 4:64.*
Sivapalaratnam et al. Circulation. 2008. 118:S_563.*
Feng et al., "Clinical Significance of Soluble Hemoglobin Scavenger Receptor CD163 (sCD163) in Sepsis, a Prospective Study," PLoS One 7(7): e38400, 9 pages, 2012.
Johnson et al., "Gene Expression Profiles Differentiate Between Sterile SIRS and Early Sepsis," Annals of Surgery 245(4): 611-621, Apr. 2007.
Sutherland et al., "Development and validation of a novel molecular biomarker diagnostic test for the early detection of sepsis," Critical Care 15(3): R149, 11 pages, 2011.
Wong et al., "Toward a clinically feasible gene expression-based subclassification strategy for septic shock: proof of concept," Critical Care Medicine 38(10): 1955-1961, Oct. 2010.
Wong et al., "Identification of pediatric septic shock subclasses based on genome-wide expression profiling," BMC Medicine 7:34, 12 pages, Jul. 22, 2009.
International Search Report and Written Opinion for International Application No. PCT/AU2014/050075, dated Dec. 22, 2014, 28 pages.
International Preliminary Report on Patentability for International Application No. PCT/AU2014/050075, dated Sep. 2, 2015, 14 pages.
"Introduction to TaqMan® and SYBR® Green Chemistries for Real-Time PCR." Applied Biosystems (2010); 17 pages.
"TaqMan® Gene Expression Assays." Applied Biosystems (2010); 69 pages.
Benjamini and Hochberg, Journal of the Royal Statistical Society. Series B (Methodological) 57.1: 289-300 (1995).
Clarke, Michael F., et al. "Cancer stem cells—perspectives on current status and future directions: AACR Workshop on cancer stem cells." Cancer Research (2006); 66.19: 9339-9344.

(Continued)

*Primary Examiner* — Joseph G. Dauner

(57) ABSTRACT

Disclosed are method and apparatus for identifying biomarkers and in particular for identifying biomarkers for use in making clinical assessments, such as early diagnostic, diagnostic, disease stage, disease severity, disease subtype, response to therapy or prognostic assessments. In one particular example, the techniques are applied to allow assessments of patients suffering from, suspected of suffering from, or with clinical signs of SIRS (Systemic Inflammatory Response Syndrome) being either infection-negative SIRS or infection-positive SIRS.

1 Claim, 166 Drawing Sheets

Specification includes a Sequence Listing.

(56) References Cited

OTHER PUBLICATIONS

Dos Anjos Pultz et al., "Far Beyond the Usual Biomarkers in Breast Cancer: A Review." J. Cancer 5, 559-571 (2016).
International Search Report and Written Opinion for International Application No. PCT/AU2015/050043, dated Apr. 23, 2015, 17 pages.
International Spreliminary Report on Patentability for International Application No. PCT/AU2015/050043, dated Mar. 22, 2016, 100 pages.
Liu et al., "Gene Expression Omnibus (GEO), GEO2R Analysis of Dataset GSE6883." The prognistic role of a gene signature from tumorigenic breast-cancer cells. (Summary and Tables) Engl. J. Med. 356.3: 217-226 (2007). PMID: 17229949.
Liu, Rui, et al. "The prognostic role of a gene signature from tumorigenic breast-cancer cells." New England Journal of Medicine (2007); 356.3: 217-226.
Markoulatos, P., et al. "Multiplex polymerase chain reaction: a practical approach." Journal of Clinical Laboratory Analysis (2002); 16.1: 47-51.
McHugh, Leo, et al. "A molecular host response assay to discriminate between sepsis and infection-negative systemic inflammation in critically ill patients: discovery and validation in independent cohorts." PLoS Med (2015); 12.12: e1001916, 35 pages.
Pankla et al. "Genomic Transcriptional Profiling Identifies a Candidate Blood Biomarker Signature for the Diagnosis of Septicemic Melioidosis." Genome Biology (2009); vol. 10, Issue 11, Article R127, 22 pages.
Perkel, J.M. "Overcoming the Challenges of Multiplex PCR." www.biocompare.com/Editorial-Articles/117895-Multiplex-PCR, Oct. 23, 2012, 4 pages.
Ramilo, Octavio, et al. "Gene expression patterns in blood leukocytes discriminate patients with acute infections." Blood (2007); 109.5: 2066-2077, and Supplemental Material.
Reinhart, Konrad et al., "New Approaches to Sepsis: Molecular Diagnostics and Biomarkers." Clinical Microbiology Reviews (2012); 25(4): 609-634.
Schlame, Michael, et al. "Study of platelet-activating factor acetylhydrolase in the perioperative period of patients undergoing cardiac surgery." Shock (1998); 9.5: 313-319.

Sweeney, Timothy E., et al. "A comprehensive time-course-based multicohort analysis of sepsis and sterile inflammation reveals a robust diagnostic gene set." Science Translational Medicine (2015); 7.287: 287ra71-287ra71.
Sweeney, Timothy E., et al. "Robust classification of bacterial and viral infections via integrated host gene expression diagnostics." Science Translational Medicine (2016); 8.346: 346ra91-346ra91.
Tang, Benjamin MP, et al. "Gene-expression profiling of peripheral blood mononuclear cells in sepsis." Critical Care Medicine (2009); 37.3: 882-888.
Tsalik, Ephraim L., et al. "Host gene expression classifiers diagnose acute respiratory illness etiology." Science Translational Medicine (2016); 8.322: 322ra11-322ra11.
Vincent, Jean-Louis, "The Clinical Challenge of Sepsis Identification and Monitoring." PLoS Med (2016); 13: e1002022-10, 10 pages.
Bertolini, Edson, et al. "Single-step multiplex RT-PCR for simultaneous and colourimetric detection of six RNA viruses in olive trees." Journal of Virological Methods (2001); 96.1: 33-41.
Casserly, Brian, et al. "Multimarker panels in sepsis." Critical Care Clinics (2011); 27.2: 391-405.
Kern, Scott E. "Why your new cancer biomarker may never work: recurrent patterns and remarkable diversity in biomarker failures." Cancer Research (2012); 72.23: 6097-6101.
LaBaer, Joshua. "So, you want to look for biomarkers (introduction to the special biomarkers issue)." Journal of Proteome Research (2005); 4.4: 1053-1059.
Monforte and McPhail. "Strategy for gene expression-based biomarker discovery." BioTechniques (2005); 5: 25-29.
Riedmaier and Pfaffl. "Transcriptional biomarkers—high throughput screening, quantitative verification, and bioinformatical validation methods." Methods (2013); 59.1: 3-9.
Peters et al., "Real-time RT-PCR: considerations for efficient and sensitive assay design." Journal of Immunological Methods (2004); 286 (1-2): 203-217.
Cobb, et al., "Sepsis gene expression profiling: Murine splenic compared with hepatic responses determined by using complementary DNA microarrays." Critical Care Medicine (2002); 30 (12): 2711-2721.
Enard, et al., "Intra- and Interspecific Variation in Primate Gene Expression Patterns." Science (2002); 296 (5566): 340-343.

* cited by examiner

BIOMARKER IDENTIFICATION

RELATED APPLICATIONS

This application is a continuation of U.S. application Ser. No. 14/714,182, entitled "Biomarker Identification," filed May 15, 2015, which is a continuation of International Application No. PCT/AU2014/050075 entitled "Biomarker Identification," filed Jun. 18, 2014, which claims priority to Australian Provisional Application No. 2013902243 entitled "Biomarker Identification", filed on 20 Jun. 2013, the subject matter of which is hereby incorporated herein by reference in its entirety.

FIELD OF THE INVENTION

The present invention relates to a method and apparatus for identifying biomarkers and in particular for identifying biomarkers for use in making clinical assessments, such as early diagnostic, diagnostic, disease stage, disease severity, disease subtype, response to therapy or prognostic assessments. In one particular example, the techniques are applied to allow assessments of patients suffering from, suspected of suffering from, or with clinical signs of SIRS (Systemic Inflammatory Response Syndrome) being either infection-negative SIRS (inSIRS) or infection-positive SIRS (ipSIRS).

STATEMENT REGARDING SEQUENCE LISTING

The Sequence Listing associated with this application is provided in text format in lieu of a paper copy, and is hereby incorporated by reference into the specification. The name of the text file containing the Sequence Listing is DAVI_036_01US_ST25.txt. The text file is 2 MB, was created on Jul. 1, 2016, and is being submitted electronically via EFS-Web.

DESCRIPTION OF THE PRIOR ART

The reference in this specification to any prior publication (or information derived from it), or to any matter which is known, is not, and should not be taken as an acknowledgement or admission or any form of suggestion that the prior publication (or information derived from it) or known matter forms part of the common general knowledge in the field of endeavour to which this specification relates.

The analysis of gene expression products for diagnostic purposes is known. Such analysis requires identification of one or more genes that can be used to generate a signature for use in distinguishing between different conditions. However, such identification can require the analysis of many gene expression products, which can be mathematically complex, computationally expensive and hence difficult. Much of the biomarker discovery process is devoted to identifying a subset of the data that may have relevant import, from which a signature is derived using a combination of these values to produce a model for diagnostic or prognostic use.

WO2004044236 describes a method of determining the status of a subject. In particular, this is achieved by obtaining subject data including respective values for each of a number of parameters, the parameter values being indicative of the current biological status of the subject. The subject data are compared to predetermined data that includes values for at least some of the parameters and an indication of the condition. The status of the subject, and in particular, the presence and/or absence of the one or more conditions, can then be determined in accordance with the results of the comparison.

SUMMARY OF THE INVENTION

In one aspect, the present invention provides apparatus for identifying biomarkers, the apparatus including an electronic processing device that:
  uses reference data from a plurality of individuals to define a number of groups of individuals, the reference data including measurements of the activity of a plurality of reference biomarkers;
  uses a plurality of analysis techniques to identify a number of potential biomarkers from the plurality of reference biomarkers that are potentially useful for distinguishing the groups of individuals, allowing the potential biomarkers to be used in generating signatures for use in clinical assessments.

Suitably, the electronic processing device, for each analysis technique:
  using the analysis technique, identifies a number of reference biomarkers that best distinguish the groups of individuals;
  determines if the predictive performance of the identified reference biomarkers exceeds a predetermined threshold; and,
  in response to a successful determination, determines the identified reference biomarkers to be potential biomarkers.

In some embodiments, the number of reference biomarkers is at least one of:
  less than 10;
  more than 1;
  between 2 and 8; and,
  5.

In some embodiments, the predetermined threshold is at least one of:
  at least 90%;
  at least 85%; and,
  at least 80%.

Suitably, the electronic processing device:
  adds potential biomarkers to a potential biomarker collection; and,
  removes the potential biomarkers from a reference biomarker collection.

Suitably, for each of a plurality of analysis techniques the electronic processing device repeatedly identifies reference biomarkers as potential biomarkers until the predictive performance of the identified reference biomarkers falls below the predetermined threshold.

The electronic processing device may iteratively identify potential biomarkers.

In some embodiments, the electronic processing device uses a number of iterations including at least one of:
  at least 100;
  at least 500;
  at least 1000;
  at least 2000; and,
  at least 5000.

The electronic processing device may repeatedly determine potential biomarkers until a predetermined number of potential biomarkers are identified.

Suitably, the predetermined number of potential biomarkers includes at least one of:

at least 100;
less than 500;
about 200.

In some embodiments, the analysis techniques include at least one of:
regression techniques;
correlation analysis; and,
a combination of regression and correlation techniques.

Suitably, the analysis techniques include:
sparse PLS;
random forest; and,
support vector machines.

In some embodiments, the electronic processing device:
removes a validation subgroup from the reference data prior to determining the potential biomarkers;
determines the potential biomarkers using the reference data without the validation subgroup; and,
uses the validation subgroup to validate at least one of:
the potential biomarkers; and,
signatures including a number of the potential biomarkers.

In some embodiments, the processing system determines the number of groups by classifying the individuals using at least one of:
an indication of a presence, absence, degree, or stage, or progression of a condition;
phenotypic traits associated with the individuals;
genetic information associated with the individuals;
biomarkers associated with the individuals.

Suitably, the processing system determines groups at least in part using input commands from a user.

The reference data may include time series data indicative of the progression of a condition.

In some embodiments, the time series data is indicative of whether a condition that is at least one of:
improving;
worsening; and,
static.

The reference data may include for each of the individuals an indication of at least one of:
an activity of each of the reference biomarkers;
a degree of a condition;
a stage of a condition;
a presence of a condition;
an absence of a condition;
an indication of a condition progression;
phenotypic information;
genetic information; and,
a SOFA score.

In some embodiments, the electronic processing device identifies a number of potential biomarkers for use as signature biomarkers, the signature biomarkers being used in generating the signatures.

Suitably, the electronic processing device:
determines a clinical assessment; and,
identifies the signature biomarkers for the clinical assessment.

Suitably, the electronic processing device:
determines second groups of individuals relevant to the clinical assessment;
using a second analysis technique, identifies a number of the potential biomarkers that best distinguish the second groups of individuals;
determines if the predictive performance of the identified potential biomarkers exceeds a predetermined threshold; and,
in response to a successful determination, determines the identified potential biomarkers to be signature biomarkers.

In some embodiments, the electronic processing device, in response to an unsuccessful determination:
modifies parameters of the second analysis technique; and,
uses the second analysis technique to identify alternative potential biomarkers.

In some embodiments, the electronic processing device:
determines if the identified potential biomarkers are to be excluded; and,
in response to a successful determination:
removes the potential biomarkers from a potential biomarker database; and,
uses the second analysis technique to identify alternative potential biomarkers for use as signature biomarkers.

Suitably, the second analysis technique includes at least one of:
ordinal regression and,
support vector machines.

In some embodiments, the signatures are indicative of:
activities of each of a number of signature biomarkers; and,
at least one of:
a SOFA score; and,
a presence, absence, degree, or stage, or progression of a condition.

The signatures may be indicative of a presence, absence, degree, or stage or progression of at least one of:
infection-negative SIRS; and,
infection-positive SIRS.

In some embodiments, activities of at least some of the potential biomarkers are indicative of at least one of:
a presence, absence, degree, or stage, or progression of SIRS;
a healthy diagnosis;
a presence, absence, degree, or stage, or progression of infection positive SIRS; and,
a presence, absence, degree, or stage, or progression of infection negative SIRS.

Suitably, an activity of biomarkers are indicative of a level or abundance of a molecule selected from one or more of:
A nucleic acid molecule;
A proteinaceous molecule;
An amino acid
A carbohydrate;
A lipid;
A steroid;
An inorganic molecule;
An ion;
A drug;
A chemical;
A metabolite;
A toxin;
A nutrient;
A gas;
A cell;
A pathogenic organism; and,
A non pathogenic organism.

In another aspect, the present invention provides a method for determining the likelihood of the presence or absence of a condition selected from a healthy condition (e.g., a normal condition or one in which inSIRS and ipSIRS are absent), SIRS generally (i.e., not distinguishing between inSIRS or ipSIRS), inSIRS or ipSIRS, or to assess the likelihood of the presence, absence or risk of development of a stage of ipSIRS (e.g., a stage of ipSIRS with a particular severity), the method comprising: (1) correlating a reference Inflammatory Response Syndrome (IRS) biomarker profile with the presence or absence of a condition selected from a healthy condition, SIRS, inSIRS, ipSIRS, or a particular stage of ipSIRS, wherein the reference IRS biomarker profile evaluates at least one IRS biomarker; (2) obtaining an IRS biomarker profile of a sample from a subject, wherein the sample IRS biomarker profile evaluates for an individual IRS biomarker in the reference IRS biomarker profile a corresponding IRS biomarker; and (3) determining a likelihood of the subject having or not having the condition based on the sample IRS biomarker profile and the reference IRS biomarker profile, wherein an individual IRS biomarker is an expression product of an IRS biomarker gene selected from the group consisting of: TLR5; CD177; VNN1; UBE2J1; IMP3; RNASE2//LOC643332; CLEC4D; C3AR1; GPR56; ARG1; FCGR1A//FCGR1B//FCGR1C; C11orf82; FAR2; GNLY; GALNT3; OMG; SLC37A3; BMX//HNRPDL; STOM; TDRD9; KREMEN1; FAIM3; CLEC4E; IL18R1; ACER3; ERLIN1; TGFBR1; FKBP5//LOC285847; GPR84; C7orf53; PLB1; DSE; PTGDR; CAMK4; DNAJC13; TNFAIP6; FOXD4L3//FOXD4L6//FOXD4//DOXD4L1//FOXD4L2//FOXD4L4//FOXD4L5; MMP9//LOC100128028; GSR; KLRF1; SH2D1B; ANKRD34B; SGMS2; B3GNT5//MCF2L2; GK3P//GK; PFKFB2; PICALM; METTL7B; HIST1H4C; C9orf72; HIST1H3I; SLC15A2; TLR10; ADM; CD274; CRIP1; LRRN3; HLA-DPB1; VAMP2; SMPDL3A; IF116; JKAMP; MRPL41; SLC1A3; OLFM4; CASS4; TCN1; WSB2; CLU; ODZ1; KPNA5; PLACE; CD63; HPSE; C1orf161; DDAH2; KLRK1//KLRC4; ATP13A3; ITK; PMAIP1; LOC284757; GOT2; PDGFC; B3GAT3; HIST1H4E; HPGD; FGFBP2; LRRC70//IPO11; TMEM144//LOC285505; CDS2; BPI; ECHDC3; CCR3; HSPC159; OLAH; PPP2R5A//SNORA16B; TMTC1; EAF2//HCG11//LOC647979; RCBTB2//LOC100131993; SEC24A//SAR1B; SH3PXD2B; HMGB2; KLRD1; CHI3L1; FRMD3; SLC39A9; GIMAP7; ANAPC11; EXOSC4; gene for IL-1beta-regulated neutrophil survival protein as set forth in GenBank Accession No. AF234262; INSIG1; FOLR3//FOLR2; RUNX2; PRR13//PCBP2; HIST1H4L; LGALS1; CCR1; TPST1; HLA-DRA; CD163; FFAR2; PHOSPHO1; PPIF; MTHFS; DNAJC9//FAM149B1//RPL26; LCN2; EIF2AK2; LGALS2; SIAE; AP3B2; ABCA13; gene for transcript set forth in GenBank Accession No. AK098012; EFCAB2; HIST1H2AA; HINT1; HIST1H3J; CDA; SAP30; AGTRAP; SUCNR1; MTRR; PLA2G7; AIG1; PCOLCE2; GAB2; HS2ST1//UBA2; HIST1H3A; C22orf37; HLA-DPA1; VOPP1//LOC100128019; SLC39A8; MKI67; SLC11A1; AREG; ABCA1; DAAM2//LOC100131657; LTF; TREML1; GSTO1; PTGER2; CEACAM8; CLEC4A; PMS2CL//PMS2; REIN; PDE3B; SULF2; NEK6//LOC100129034; CENPK; TRAF3; GPR65; IRF4; MACF1; AMFR; RPL17//SNORD58B; IRS2; JUP; CD24; GALNT2; HSP90AB1//HSP90AB3P//HSP90AB2P; GLT25D1; OR9A2; HDHD1A; ACTA2; ACPL2; LRRFIP1; KCNMA1; OCR1; ITGA4//CERKL; EIF1AX//SCARNA9L//EIF1AP1; SFRS9; DPH3; ERGIC1; CD300A; NF-E4; MINPP1; TRIM21; ZNF28; NPCDR1; gene for protein FLJ21394 as set forth in GenBank Accession No. BC013935; gene for transcript set forth in GenBank Accession No. AK000992; ICAM1; TAF13; P4HA1//RPL17; C15orf54; KLHL5; HAL; DLEU2//DLEU2L; ANKRD28; LY6G5B//CSNK2B; KIAA1257//ACAD9//LOC100132731; MGST3; KIAA0746; HSPB1//HSPBL2; CCR4; TYMS; RRP12//LOC644215; CCDC125; HIST1H2BM; PDK4; ABCG1; IL1B; THBS1; ITGA2B; LHFP; LAIR1//LAIR2; HIST1H3B; ZRANB1; TIMM10; FSD1L//GARNL1; HIST1H2AJ//HIST1H2AI; PTGS1; gene for transcript set forth in GenBank Accession No. BC008667; UBE2F//C20orf194//SCLY; HIST1H3C; FAM118A; CCRL2; E2F6; MPZL3; SRXN1; CD151; HIST1H3H; FSD1L; RFESD//SPATA9; TPX2; S100B; ZNF587//ZNF417; PYHIN1; KIAA1324; CEACAM6//CEACAM5; APOLD1; FABP2; KDM6B//TMEM88; IGK@//IGKC//IGKV1-5//IGKV3D-11//IGKV3-20//IGKV3D-15//LOC440871//LOC652493//LOC100291464//LOC652694//IGKV3-15//LOC650405//LOC100291682; MYL9; HIST1H2BJ; TAAR1; CLC; CYP4F3//CYP4F2; CEP97; SON; IRF1; SYNE2; MME; LASS4; DEFA4//DEFA8P; C7orf58; DYNLL1; gene for transcript set forth in GenBank Accession No. AY461701; MPO; CPM; TSHZ2; PLIN2; FAM1188; B4GALT3; RASA4//RASA4P//RASA4B//POLR2J4//LOC100132214; CTSL1//CTSLL3; NP; ATF7; SPARC; PLB1; C4orf3; POLE2; TNFRSF17; FBXL13; PLEKHA3; TMEM62//SPCS2//LOC653566; RBP7; PLEKHF2; RGS2; ATP6V0D1//LOC100132855; RPIA; CAMK1D; IL1RL1; CMTM5; AIF1; CFD; MPZL2; LOC100128751; IGJ; CDC26; PPP1R2//PPP1R2P3; IL5RA; ARL17P1//ARL17; ATP5L//ATP5L2; TAS2R31; HIST2H2BF//HIST2H3D; CALM2//C2orf61; SPATA6; IGLV6-57; C1orf128; KRTAP15-1; IF144; IGL@//IGLV1-44//LOC96610//IGLV2-23//IGLC1//IGLV2-18//IGLV5-45//IGLV3-25//IGLV3-12//IGLV1-36//IGLV3-27//IGLV7-46//IGLV4-3//IGLV3-16//IGLV3-19//IGLV7-43//IGLV3-22//IGLV5-37//IGLV10-54//IGLV8-61//LOC651536; gene for transcript set forth in GenBank Accession No. BC034024; SDHC; NFXL1; GLDC; DCTN5; and KIAA0101//CSNK1G1

In some embodiments, the method determines the likelihood that SIRS or a healthy condition is present or absent in the subject, and wherein the method comprises: 1) providing a correlation of a reference IRS biomarker profile with the presence or absence of SIRS or the healthy condition, wherein the reference biomarker profile evaluates at least one IRS biomarker selected from CD177, CLEC4D, BMX, VNN1, GPR84, ARG1, IL18R1, ERLIN1, IMP3, TLR5, UBE2J1, GPR56, FCGR1A, SLC1A3, SLC37A3, FAIM3, C3AR1, RNASE2, TNFAIP6, GNLY, OMG, FAR2, OLAH, CAMK4, METTL7B, B3GNT5, CLEC4E, MMP9, KREMEN1, GALNT3, PTGDR, TDRD9, GK3P, FKBP5, STOM, SMPDL3A, PFKFB2, ANKRD34B, SGMS2, DNAJC13, LRRN3, SH2D1B, C1orf161, HIST1H4C, IF116, ACER3, PLB1, C9orf72, HMGB2, KLRK1, C7orf53, GOT2, TCN1, DSE, CCR3, CRIP1, ITK, KLRF1, TGFBR1, GSR, HIST1H4E, HPGD, FRMD3, ABCA13, C11orf82, PPP2R5A, BPI, CASS4, AP3B2, ODZ1, TMTC1, ADM, FGFBP2, HSPC159, HLA-DRA, HIST1H3I, TMEM144, MRPL41, FOLR3, PICALM, SH3PXD2B, DDAH2, HLA-DPB1, KPNA5, PHOSPHO1, TPST1, EIF2AK2, OR9A2, OLFM4, CD163, CDA, CHI3L1, MTHFS, CLU, ANAPC11, JUP, PMAIP1, GIMAP7, KLRD1, CCR1, CD274, EFCAB2, SUCNR1, KCNMA1, LGALS2, SLC11A1, FOXD4L3, VAMP2, ITGA4, LHFP, PRR13, FFAR2, B3GAT3, EAF2, HPSE, CLC, TLR10, CCR4, HIST1H3A, CENPK, DPH3, HLA-DPA1, ATP13A3, DNAJC9, S100B, HIST1H3J, 110, RPL17, C15orf54, LRRC70, IL5RA, PLA2G7, ECHDC3, HINT1, LCN2, PPIF, SLC15A2, PMS2CL, HIST1H2AA, CEACAM8, HSP90AB1, ABCG1, PDGFC, NPCDR1, PDK4, GAB2, WSB2, FAM118A, JKAMP, TREML1, PYHIN1, IRF4, ABCA1, DAAM2, ACPL2, RCBTB2, SAP30, THBS1, PCOLCE2, GPR65, NF-E4, LTF, LASS4, B4GALT3, RETN, TIMM10, IL1B, CLEC4A, SEC24A, RUNX2, LRRFIP1, CFD, EIF1AX, ZRANB1, SULF2, EXOSC4, CCDC125, LOC284757, ANKRD28, HIST1H2AJ, CD63, PLIN2, SON, HIST1H4L, KRTAP15-1, DLEU2, MYL9, FABP2, CD24, MACF1, GSTO1, RRP12, AIG1, RASA4, FBXL13, PDE3B, CCRL2, C1orf128, E2F6, IL1RL1, CEACAM6, CYP4F3, 199, TAAR1, TSHZ2, PLB1, UBE2F; (2) obtaining a sample IRS biomarker profile from the subject, which evaluates for an individual IRS biomarker in the reference IRS biomarker profile a corresponding IRS biomarker, and (3) determining a likelihood of the subject having or not having the healthy condition or SIRS based on the sample IRS biomarker profile and the reference IRS biomarker profile.

Suitably, the method determines the likelihood that inSIRS, ipSIRS or a healthy condition is present or absent in the subject, wherein the method comprises: 1) providing a correlation of a reference IRS biomarker profile with the likelihood of having or not having inSIRS, ipSIRS or the healthy condition, wherein the reference biomarker profile evaluates at least one IRS biomarker selected from PLAC8, 132, INSIG1, CDS2, VOPP1, SLC39A9, B3GAT3, CD300A, OCR1, PTGER2, LGALS1, HIST1H4L, AMFR, SIAE, SLC39A8, TGFBR1, GAB2, MRPL41, TYMS, HIST1H3B, MPZL3, KIAA1257, OMG, HIST1H2BM, TDRD9, C22orf37, GALNT3, SYNE2, MGST3, HIST1H3I, LOC284757, TRAF3, HIST1H3C, STOM, C3AR1, KIAA0101, TNFRSF17, HAL, UBE2J1, GLT25D1, CD151, HSPB1, IMP3, PICALM, ACER3, IGL@, HIST1H2BJ, CASS4, KREMEN1, IRS2, APOLD1, RBP7, DNAJC13, ERGIC1, FSD1L, TLR5, TMEM62, SDHC, C9orf72, NP, KIAA0746, PMAIP1, DSE, SMPDL3A, DNAJC9, HIST1H3H, CDC26, CRIP1, FAR2, FRMD3, RGS2, METTL7B, CLEC4E, MME, ABCA13, PRR13, HIST1H4C, RRP12, GLDC, ECHDC3, IRF1, C7orf53, IGK@, RNASE2, FCGR1A, SAP30, PMS2CL, SLC11A1, AREG, PLB1, PPIF, GSR, NFXL1, AP3B2, DCTN5, RPL17, IGLV6-57, KLRF1, CHI3L1, ANKRD34B, OLFM4, CPM, CCDC125, GPR56, PPP1R2, 110, ACPL2, HIST1H3A, C7orf58, IRF4, ANAPC11, HIST1H3J, KLRD1, GPR84, ZRANB1, KDM6B, TPST1, HINT1, DAAM2, PTGDR, FKBP5, HSP90AB1, HPGD, IF116, CD177, TAS2R31, CD163, B4GALT3, EIF1AX, CYP4F3, HIST1H2AA, LASS4 (where if a gene name is not provided then a SEQ ID NO. is provided).; (2) obtaining a sample IRS biomarker profile from the subject, which evaluates for an individual IRS biomarker in the reference IRS biomarker profile a corresponding IRS biomarker; and (3) determining a likelihood of the subject having or not having inSIRS, ipSIRS or a healthy condition the condition based on the sample IRS biomarker profile and the reference IRS biomarker profile.

In some embodiments, the method determines the likelihood that inSIRS or ipSIRS is present or absent in the subject, wherein the method comprises: 1) providing a correlation of a reference IRS biomarker profile with the likelihood of having or not having inSIRS or ipSIRS, wherein the reference biomarker profile evaluates at least one IRS biomarker selected from C11orf82, PLAC8, 132, INSIG1, CDS2, VOPP1, SLC39A9, FOXD4L3, WSB2, CD63, CD274, B3GAT3, CD300A, OCR1, JKAMP, TLR10, PTGER2, PDGFC, LGALS1, HIST1H4L, AGTRAP, AMFR, SIAE, 200, SLC15A2, SLC39A8, TGFBR1, DDAH2, HPSE, SUCNR1, MTRR, GAB2, P4HA1, HS2ST1, MRPL41, TYMS, RUNX2, GSTO1, LRRC70, HIST1H3B, RCBTB2, MPZL3, KIAA1257, AIG1, NEK6, OMG, HIST1H2BM, TDRD9, GALNT3, ATP13A3, C22orf37, SYNE2, ADM, MGST3, PDE3B, HIST1H3I, LOC284757, TRAF3, HIST1H3C, STOM, KLHL5, EXOSC4, C3AR1, KIAA0101, TNFRSF17, HAL, UBE2J1, GLT25D1, CD151, TPX2, PCOLCE2, HSPB1, EAF2, IMP3, PICALM, ACER3, IGL@, HIST1H2BJ, CASS4, ACTA2, PTGS1, KREMEN1, IRS2, TAF13, FSD1L, APOLD1, RBP7, DNAJC13, SEC24A, ERGIC1, FSD1L, TLR5, MKI67, TMEM62, CLEC4A, SDHC, C9orf72, NP, CLU, ABCA1, KIAA0746, PMAIP1, DSE, CMTM5, SMPDL3A, DNAJC9, HDHD1A, HIST1H3H, CDC26, ICAM1, LOC100128751, FAR2, CRIP1, MPZL2, FRMD3, CTSL1, METTL7B, RGS2, CLEC4E, MME, ABCA13, PRR13, HIST1H4C, RRP12, GLDC, ECHDC3, ITGA2B, C7orf53, IRF1, 268, IGK@, RNASE2, FCGR1A, UBE2F, SAP30, LAIR1, PMS2CL, SLC11A1, PLB1, AREG, PPIF, GSR, NFXL1, AP3B2, DCTN5, RPL17, PLA2G7, GALNT2, IGLV6-57, KLRF1, CHI3L1, ANKRD34B, OLFM4, 199, CPM, CCDC125, SULF2, LTF, GPR56, MACF1, PPP1R2, DYNLL1, LCN2, FFAR2, SFRS9, IGJ, FAM118B, 110, ACPL2, HIST1H3A, C7orf58, ANAPC11, HIST1H3J, IRF4, MPO, TREML1, KLRD1, GPR84, CCRL2, CAMK1D, CCR1, ZRANB1, KDM6B, TPST1, HINT1, DAAM2, PTGDR, FKBP5, CD24, HSP90AB1, HPGD, CEACAM8, DEFA4, IL1B, IF116, CD177, KIAA1324, SRXN1, TAS2R31, CEACAM6, CD163, B4GALT3, ANKRD28, TAAR1, EIF1AX, CYP4F3, 314, HIST1H2AA, LY6G5B, LASS4 (where if a gene name is not provided then a SEQ ID NO. is provided); (2) obtaining a sample IRS biomarker profile from the subject, which evaluates for an individual IRS biomarker in the reference IRS biomarker profile a corresponding IRS biomarker; and (3) determining a likelihood of the subject having or not having inSIRS or ipSIRS based on the sample IRS biomarker profile and the reference IRS biomarker profile.

Suitably, the method determines the likelihood that a stage of ipSIRS selected from mild sepsis, severe sepsis and septic shock is present or absent the subject, wherein the method comprises: 1) providing a correlation of a reference IRS biomarker profile with the likelihood of having or not having the stage of ipSIRS, wherein the reference biomarker IRS biomarker profile evaluates at least one IRS biomarker selected from PLEKHA3, PLEKHF2, 232, SFRS9, ZNF587, KPNA5, LOC284757, GPR65, VAMP2, SLC1A3, ITK, ATF7, ZNF28, AIF1, MINPP1, GIMAP7, MKI67, IRF4, TSHZ2, HLA-DPB1, EFCAB2, POLE2, FAIM3, 110, CAMK4, TRIM21, IF144, CENPK, ATP5L, GPR56, HLA-DPA1, C4orf3, GSR, GNLY, RFESD, BPI, HIST1H2AA, NF-E4, CALM2, EIF1AX, E2F6, ARL17P1, TLR5, SH3PXD2B, FAM118A, RETN, PMAIP1, DNAJC9, PCOLCE2, TPX2, BMX, LRRFIP1, DLEU2, JKAMP, JUP, ABCG1, SLC39A9, B3GNT5, ACER3, LRRC70, NPCDR1, TYMS, HLA-DRA, TDRD9, FSD1L, FAR2, C7orf53, PPP1R2, SGMS2, EXOSC4, TGFBR1, CD24, TCN1, TAF13, AP3B2, CD63, SLC15A2, IL18R1, ATP6V0D1, SON, HSP90AB1, CEACAM8, SMPDL3A, IMP3, SEC24A, PICALM, 199, CEACAM6, CYP4F3, OLAH, ECHDC3, ODZ1, KIAA0746, KIAA1324, HINT1, VNN1, C22orf37, FSD1L, FOLR3, IL1RL1, OMG, MTHFS, OLFM4, S100B, ITGA4, KLRD1, SLC39A8, KLHL5, KLRK1, MPO, PPIF, GOT2, LRRN3, HIST1H2AJ, CLU, LCN2, 132, CEP97, KLRF1, FBXL13, HIST1H3B, ANKRD34B, RPIA, HPGD, HIST2H2BF, GK3P (where if a gene name is not provided then a SEQ ID NO. is provided). (2) obtaining a sample IRS biomarker profile from the subject, which evaluates for an individual IRS biomarker in the reference IRS biomarker profile a corresponding IRS biomarker; and (3) determining a likelihood of the subject having or not having the stage of ipSIRS based on the sample IRS biomarker profile and the reference IRS biomarker profile.

In illustrative examples, an individual IRS biomarker is selected from the group consisting of: (a) a polynucleotide expression product comprising a nucleotide sequence that shares at least 70% (or at least 71% to at least 99% and all integer percentages in between) sequence identity with the sequence set forth in any one of SEQ ID NO: 1-319, or a complement thereof; (b) a polynucleotide expression product comprising a nucleotide sequence that encodes a polypeptide comprising the amino acid sequence set forth in any one of SEQ ID NO: 320-619; (c) a polynucleotide expression product comprising a nucleotide sequence that encodes a polypeptide that shares at least 70% (or at least 71% to at least 99% and all integer percentages in between) sequence similarity or identity with at least a portion of the sequence set forth in SEQ ID NO: 320-619; (d) a polynucleotide expression product comprising a nucleotide sequence that hybridizes to the sequence of (a), (b), (c) or a complement thereof, under medium or high stringency conditions; (e) a polypeptide expression product comprising the amino acid sequence set forth in any one of SEQ ID NO: 320-619; and (f) a polypeptide expression product comprising an amino acid sequence that shares at least 70% (or at least 71% to at least 99% and all integer percentages in between) sequence similarity or identity with the sequence set forth in any one of SEQ ID NO: 320-619.

Evaluation of IRS markers suitably includes determining the levels of individual IRS markers, which correlate with the presence or absence of a condition, as defined above.

In some embodiments, the method of determining the likelihood of the presence or absence of a condition, as broadly described above, comprises comparing the level of a first IRS biomarker in the sample IRS biomarker profile with the level of a second IRS biomarker in the sample IRS biomarker profile to provide a ratio and determining a likelihood of the presence or absence of the condition based on that ratio. In illustrative examples of this type, the determination is carried out in the absence of comparing the level of the first or second IRS biomarkers in the sample IRS biomarker profile to the level of a corresponding IRS biomarker in the reference IRS biomarker profile. Representative IRS biomarkers that are useful for these embodiments are suitably selected from those listed in Example 6 and Tables 16-21.

In a related aspect, the present invention provides a kit comprising one or more reagents and/or devices for use in performing the method of determining the likelihood of the presence or absence of a condition as broadly described above.

Another aspect of the present invention provides a method for treating, preventing or inhibiting the development of inSIRS, ipSIRS or a particular stage of ipSIRS in a subject, the method comprising: (1) correlating a reference IRS biomarker profile with the presence or absence of a condition selected from a healthy condition, SIRS, inSIRS, ipSIRS, or a particular stage of ipSIRS, wherein the reference IRS biomarker profile evaluates at least one IRS biomarker; (2) obtaining an IRS biomarker profile of a sample from a subject, wherein the sample IRS biomarker profile evaluates for an individual IRS biomarker in the reference IRS biomarker profile a corresponding IRS biomarker; (3) determining a likelihood of the subject having or not having the condition based on the sample IRS biomarker profile and the reference IRS biomarker profile, and administering to the subject, on the basis that the subject has an increased likelihood of having inSIRS, an effective amount of an agent that treats or ameliorates the symptoms or reverses or inhibits the development of inSIRS, or administering to the subject, on the basis that the subject has an increased likelihood of having ipSIRS or a particular stage of ipSIRS, an effective amount of an agent that treats or ameliorates the symptoms or reverses or inhibits the development of ipSIRS or the particular stage of ipSIRS.

Yet another aspect of the present invention provides a method of monitoring the efficacy of a particular treatment regimen in a subject towards a desired health state (e.g., healthy condition), the method comprising: (1) providing a correlation of a reference IRS biomarker profile with the likelihood of having a healthy condition; (2) obtaining a corresponding IRS biomarker profile of a subject having inSIRS, ipSIRS or a particular stage of ipSIRS after treatment with a treatment regimen, wherein a similarity of the subject's IRS biomarker profile after treatment to the reference IRS biomarker profile indicates the likelihood that the treatment regimen is effective for changing the health status of the subject to the desired health state.

Still another aspect of the present invention provides a method of correlating a reference IRS biomarker profile with an effective treatment regimen for a condition selected from inSIRS, ipSIRS or a particular stage of ipSIRS, wherein the reference IRS biomarker profile evaluates at least one IRS biomarker, the method comprising: (a) determining a sample IRS biomarker profile from a subject with the condition prior to treatment, wherein the sample IRS biomarker profile evaluates for an individual IRS biomarker in the reference IRS biomarker profile a corresponding IRS biomarker; and correlating the sample IRS biomarker profile with a treatment regimen that is effective for treating the condition.

In another aspect, the present invention provides a method of determining whether a treatment regimen is effective for treating a subject with a condition selected from inSIRS, ipSIRS or a particular stage of ipSIRS, the method comprising: (a) correlating a reference biomarker profile prior to treatment with an effective treatment regimen for the condition, wherein the reference IRS biomarker profile evaluates at least one IRS biomarker; and (b) obtaining a sample IRS biomarker profile from the subject after treatment, wherein the sample IRS biomarker profile evaluates for an individual IRS biomarker in the reference IRS biomarker profile a corresponding IRS biomarker, and wherein the sample IRS biomarker profile after treatment indicates whether the treatment regimen is effective for treating the condition in the subject.

In a further aspect, the present invention provides a method of correlating an IRS biomarker profile with a positive or negative response to a treatment regimen, the method comprising: (a) obtaining an IRS biomarker profile from a subject with a condition selected from inSIRS, ipSIRS or a particular stage of ipSIRS following commencement of the treatment regimen, wherein the IRS biomarker profile evaluates at least one IRS biomarker; and (b) correlating the IRS biomarker profile from the subject with a positive or negative response to the treatment regimen.

Another aspect of the present invention provides a method of determining a positive or negative response to a treatment regimen by a subject with a condition selected from inSIRS, ipSIRS or a particular stage of ipSIRS, the method comprising: (a) correlating a reference IRS biomarker profile with a positive or negative response to the treatment regimen, wherein the reference IRS biomarker profile evaluates at least one (e.g., 1, 2, 3, 4, 5, 6, 7, 8, 9, 10, etc.) IRS biomarker; and (b) determining a sample IRS biomarker profile from the subject, wherein the subject's sample IRS biomarker profile evaluates for an individual IRS biomarker in the reference IRS biomarker profile a corresponding IRS biomarker and indicates whether the subject is responding to the treatment regimen.

In some embodiments, the method of determining a positive or negative response to a treatment regimen further comprises: determining a first sample IRS biomarker profile from the subject prior to commencing the treatment regimen, wherein the first sample IRS biomarker profile evaluates at least one IRS biomarker; and comparing the first sample IRS biomarker profile with a second sample IRS biomarker profile from the subject after commencement of the treatment regimen, wherein the second sample IRS biomarker profile evaluates for an individual IRS biomarker in the first sample IRS biomarker profile a corresponding IRS biomarker.

BRIEF DESCRIPTION OF THE DRAWINGS

FIG. 120 shows a box and whiskers plot of ANAPC11 gene expression for healthy subjects and subjects with SIRS, mild sepsis, severe sepsis.

FIG. 121 shows a box and whiskers plot of EXOSC4 gene expression for healthy subjects and subjects with SIRS, mild sepsis, severe sepsis.

FIG. 122 shows a box and whiskers plot of NA gene expression for healthy subjects and subjects with SIRS, mild sepsis, severe sepsis.

FIG. 123 shows a box and whiskers plot of INSIG1 gene expression for healthy subjects and subjects with SIRS, mild sepsis, severe sepsis.

FIG. 124 shows a box and whiskers plot of FOLR3// FOLR2 gene expression for healthy subjects and subjects with SIRS, mild sepsis, severe sepsis.

FIG. 125 shows a box and whiskers plot of RUNX2 gene expression for healthy subjects and subjects with SIRS, mild sepsis, severe sepsis.

FIG. 126 shows a box and whiskers plot of PRR13//PCBP2 gene expression for healthy subjects and subjects with SIRS, mild sepsis, severe sepsis.

FIG. 127 shows a box and whiskers plot of HIST1H4L gene expression for healthy subjects and subjects with SIRS, mild sepsis, severe sepsis.

FIG. 128 shows a box and whiskers plot of LGALS1 gene expression for healthy subjects and subjects with SIRS, mild sepsis, severe sepsis.

FIG. 129 shows a box and whiskers plot of CCR1 gene expression for healthy subjects and subjects with SIRS, mild sepsis, severe sepsis.

FIG. 130 shows a box and whiskers plot of TPST1 gene expression for healthy subjects and subjects with SIRS, mild sepsis, severe sepsis.

FIG. 131 shows a box and whiskers plot of HLA-DRA gene expression for healthy subjects and subjects with SIRS, mild sepsis, severe sepsis.

Figure 132:
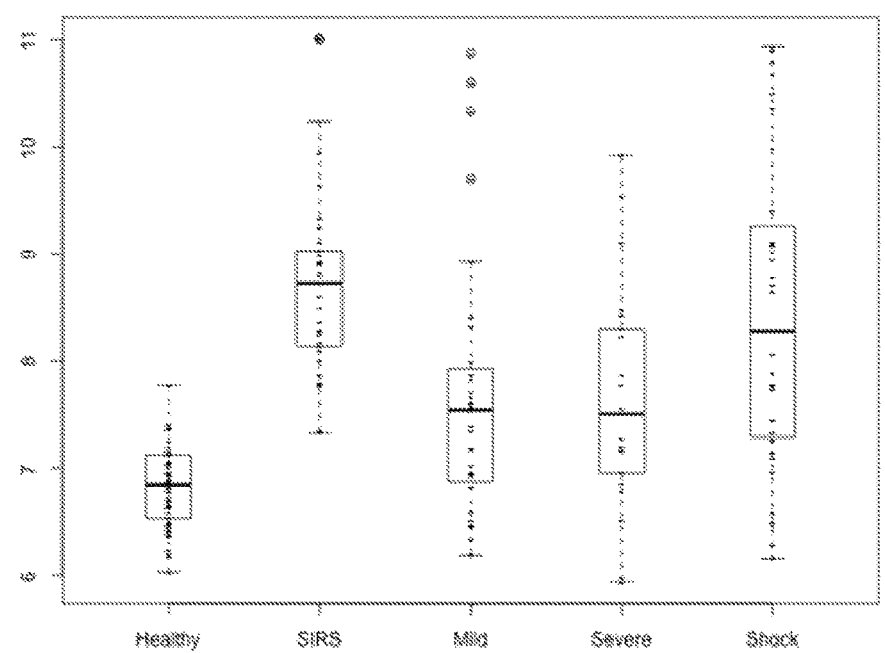

FIG. 132 shows a box and whiskers plot of CD163 gene expression for healthy subjects and subjects with SIRS, mild sepsis, severe sepsis.

Figure 133:
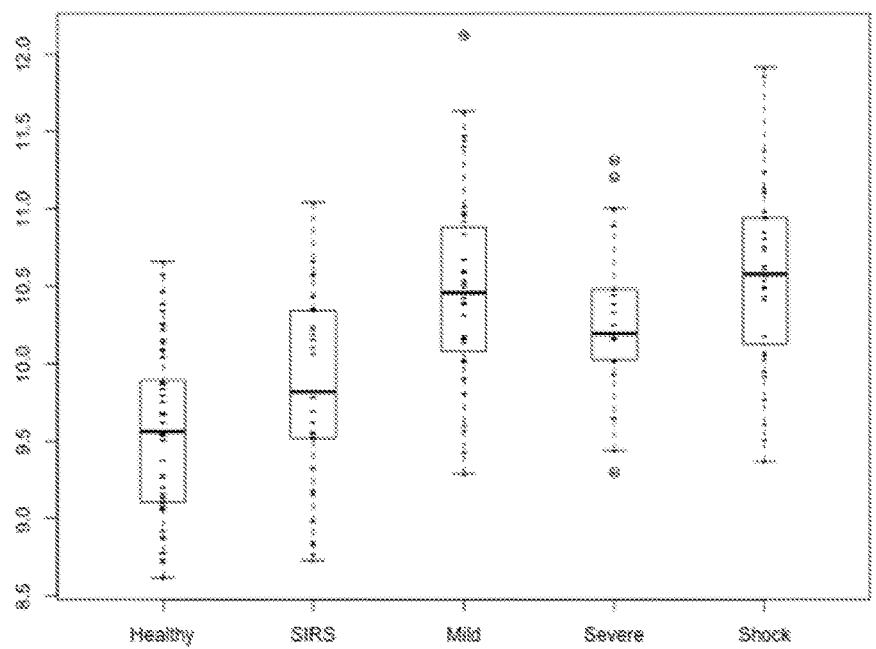

FIG. 133 shows a box and whiskers plot of FFAR2 gene expression for healthy subjects and subjects with SIRS, mild sepsis, severe sepsis.

Figure 134:
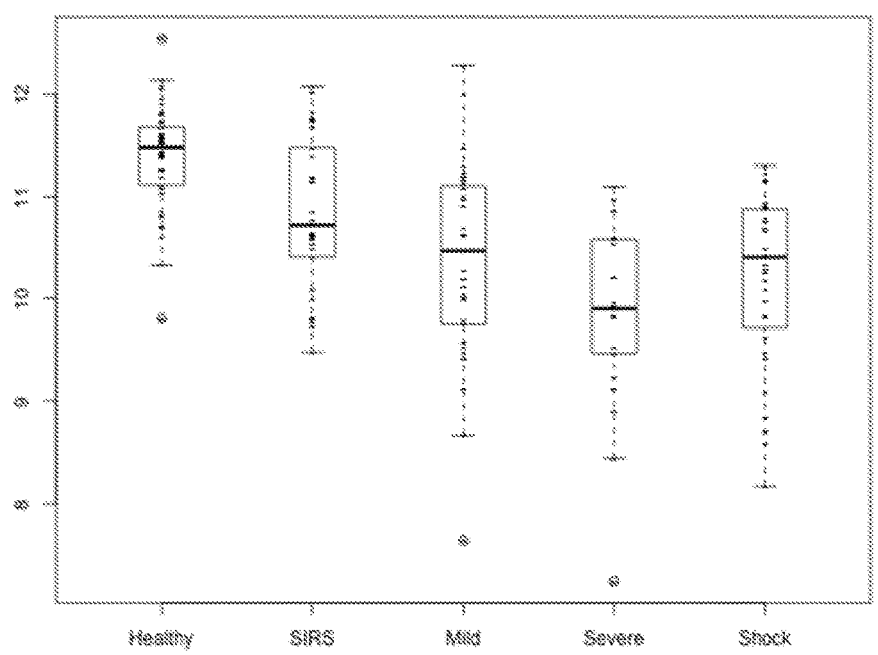

FIG. 134 shows a box and whiskers plot of PHOSPHO1 gene expression for healthy subjects and subjects with SIRS, mild sepsis, severe sepsis.

Figure 135:
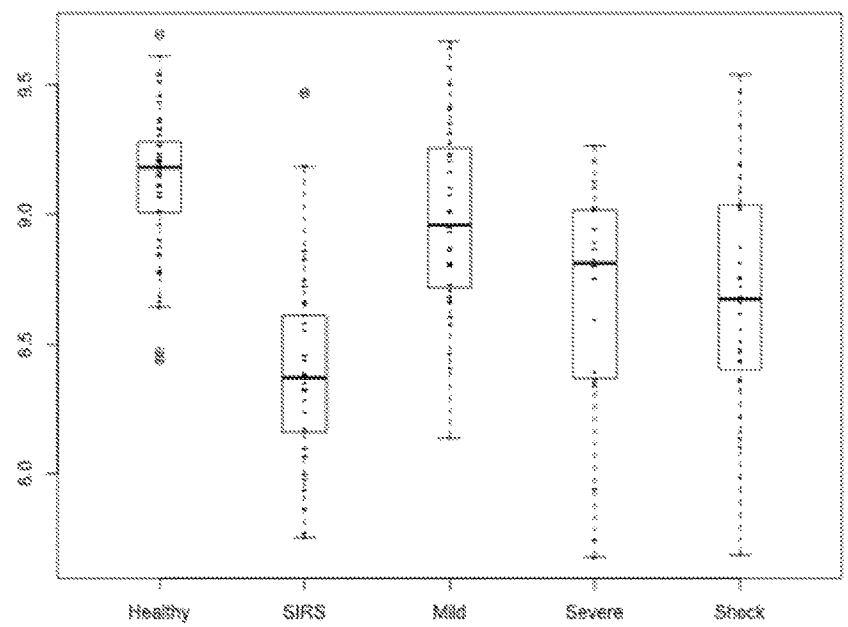

FIG. 135 shows a box and whiskers plot of PPIF gene expression for healthy subjects and subjects with SIRS, mild sepsis, severe sepsis.

Figure 136:
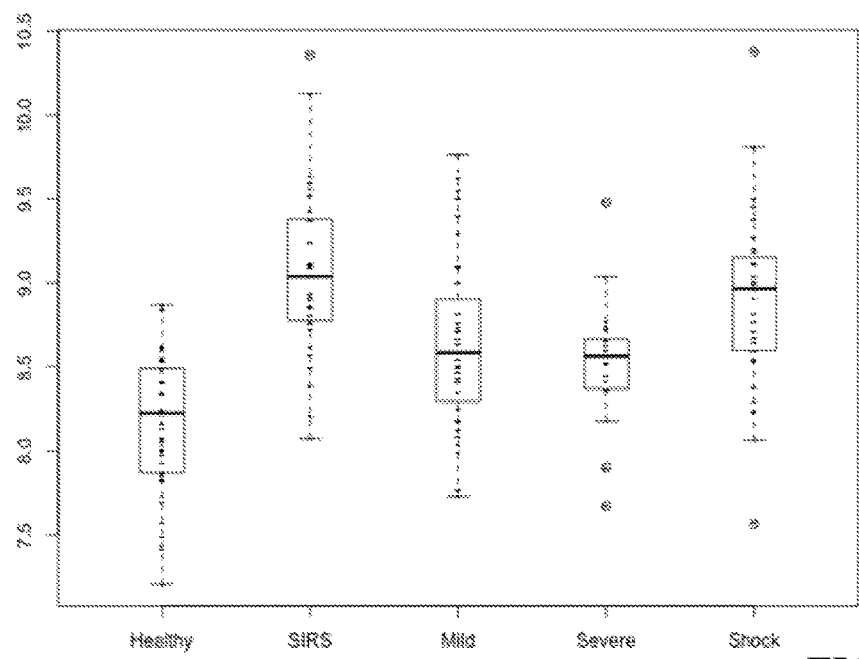

FIG. 136 shows a box and whiskers plot of MTHFS gene expression for healthy subjects and subjects with SIRS, mild sepsis, severe sepsis.

Figure 137:
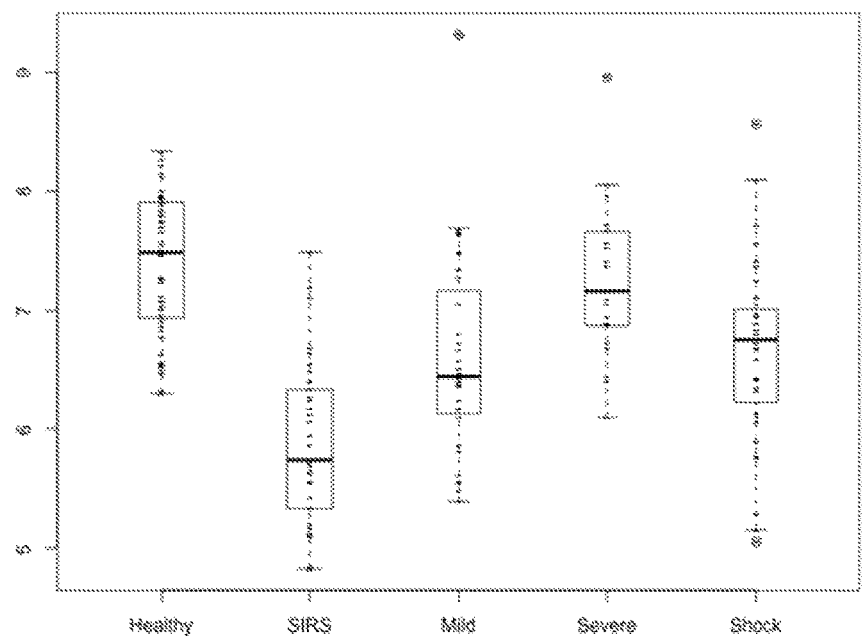

FIG. 137 shows a box and whiskers plot of DNAJC9//FAM149B1//RPL26 gene expression for healthy subjects and subjects with SIRS, mild sepsis, severe sepsis.

Figure 138:
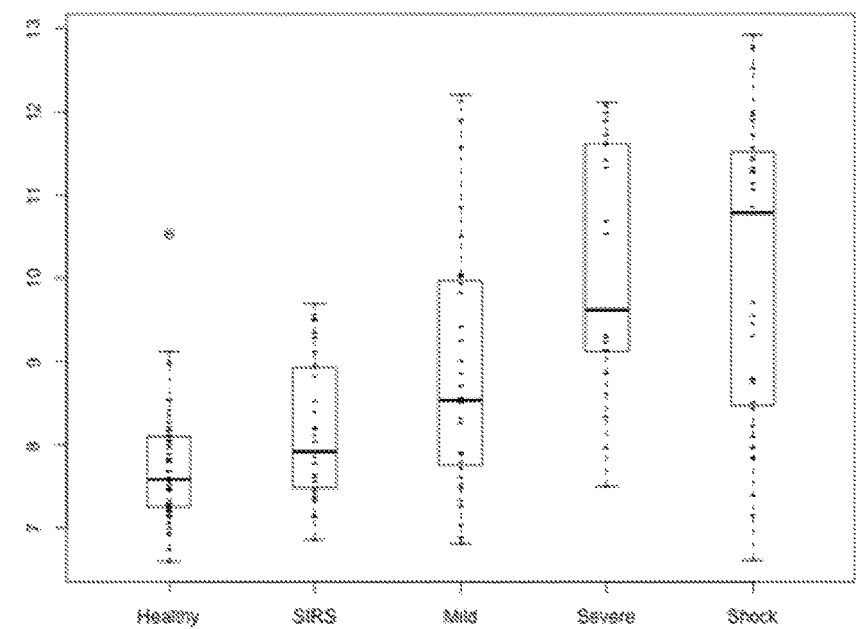

FIG. 138 shows a box and whiskers plot of LCN2 gene expression for healthy subjects and subjects with SIRS, mild sepsis, severe sepsis.

Figure 139:
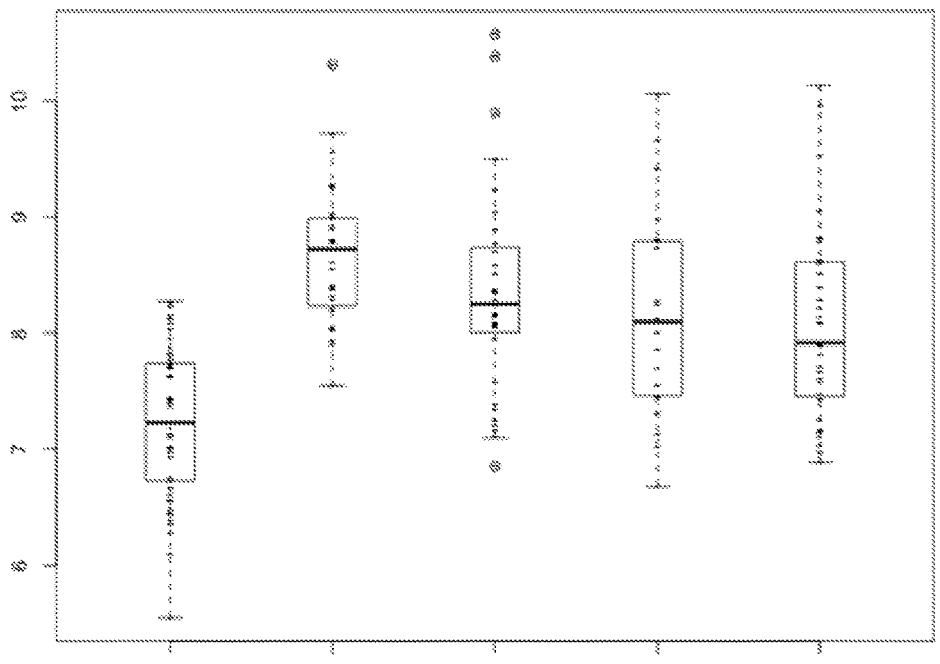

FIG. 139 shows a box and whiskers plot of EIF2AK2 gene expression for healthy subjects and subjects with SIRS, mild sepsis, severe sepsis.

Figure 140:
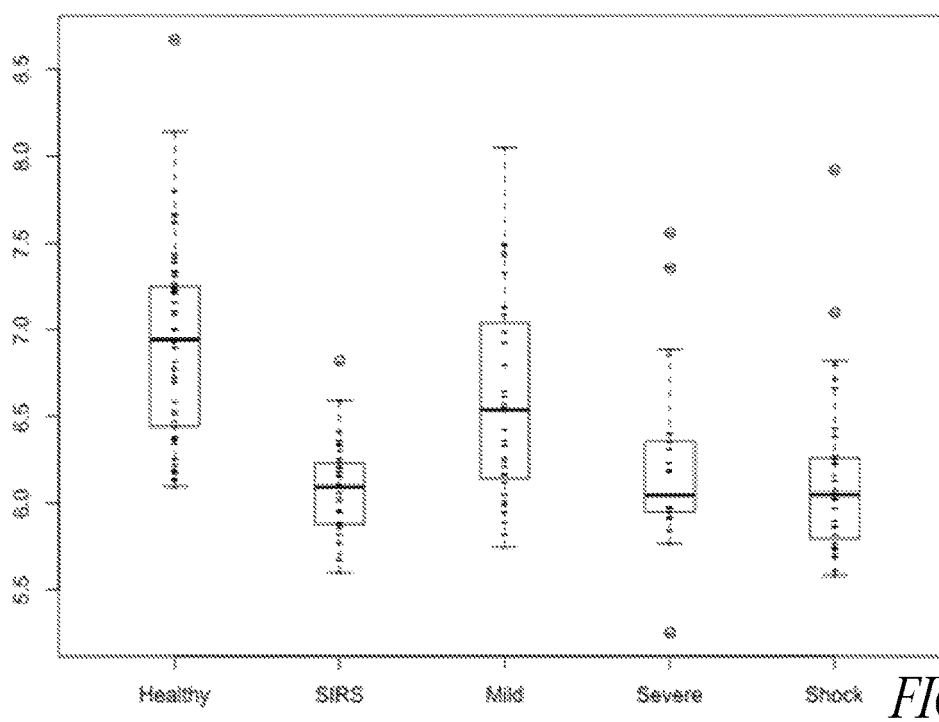

FIG. 140 shows a box and whiskers plot of LGALS2 gene expression for healthy subjects and subjects with SIRS, mild sepsis, severe sepsis.

Figure 141:
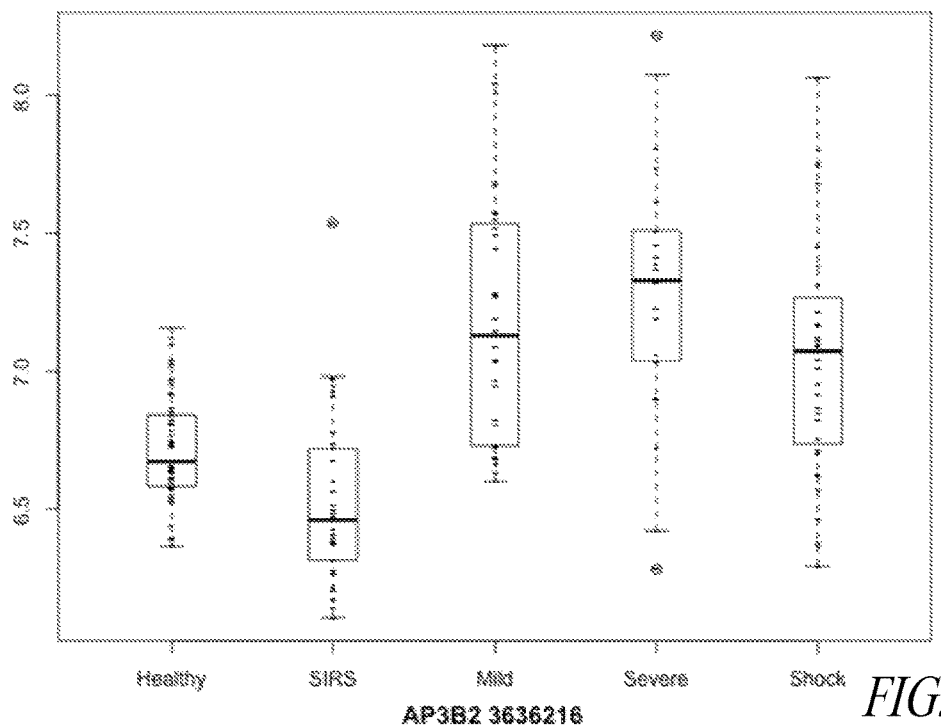

FIG. 141 shows a box and whiskers plot of SIAE gene expression for healthy subjects and subjects with SIRS, mild sepsis, severe sepsis.

Figure 142:
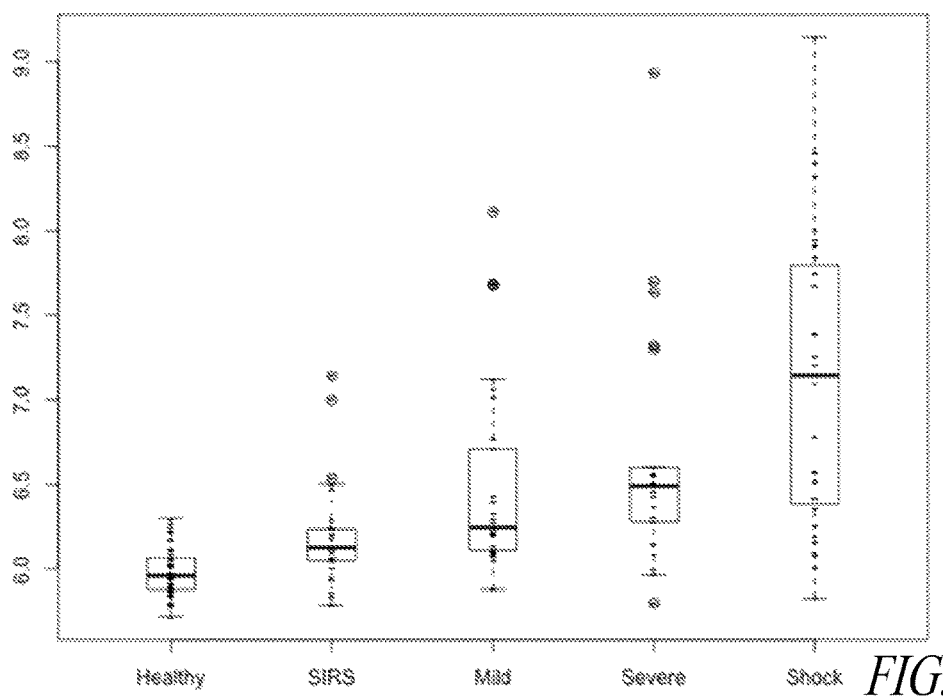

FIG. 142 shows a box and whiskers plot of AP3B2 gene expression for healthy subjects and subjects with SIRS, mild sepsis, severe sepsis.

Figure 143:
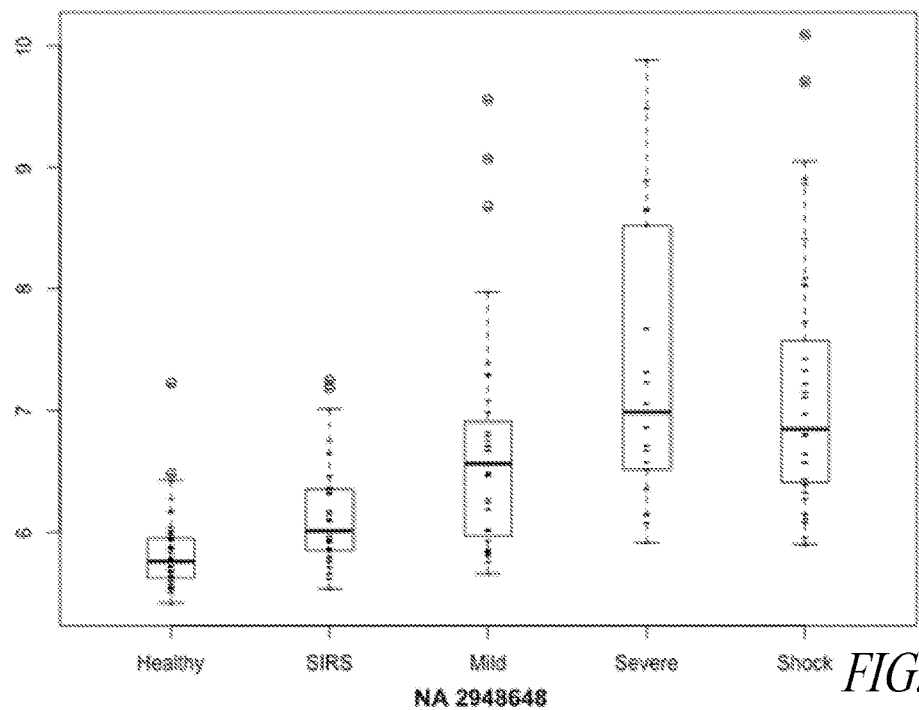

FIG. 143 shows a box and whiskers plot of ABCA13 gene expression for healthy subjects and subjects with SIRS, mild sepsis, severe sepsis.

Figure 144:
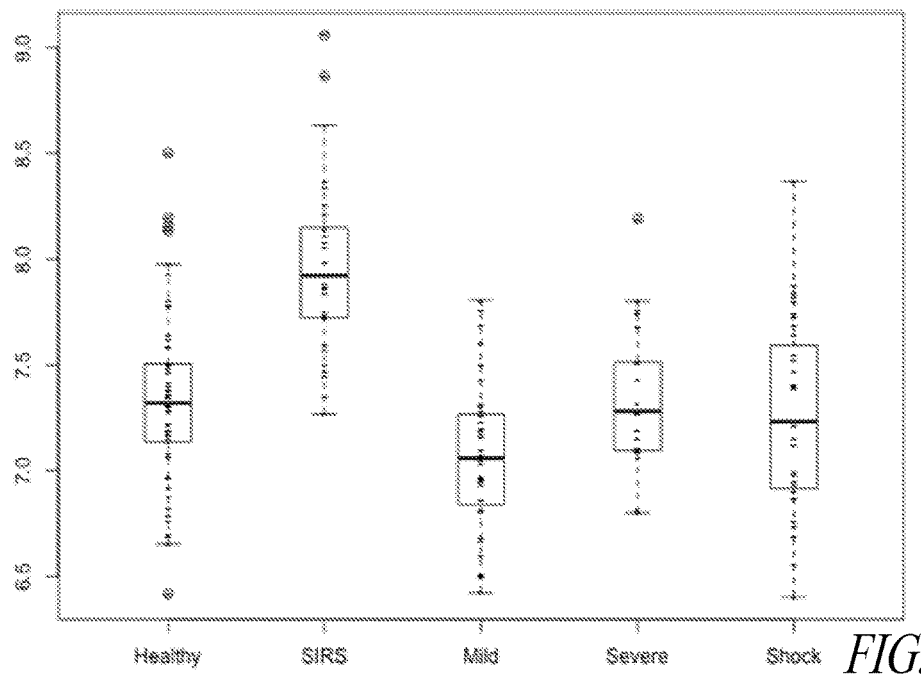

FIG. 144 shows a box and whiskers plot of NA expression for healthy subjects and subjects with SIRS, mild sepsis, severe sepsis.

Figure 145:
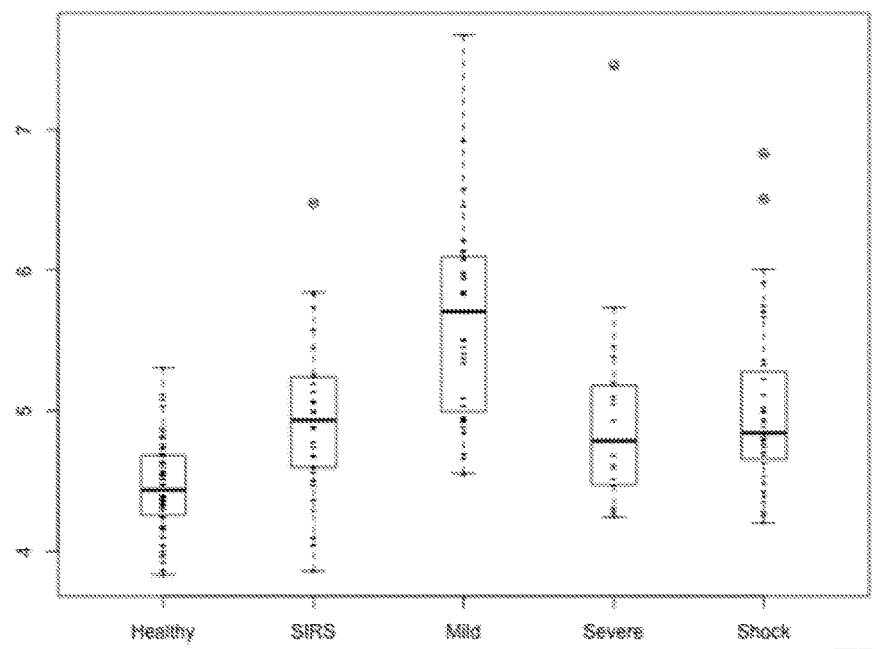

FIG. 145 shows a box and whiskers plot of EFCAB2 gene expression for healthy subjects and subjects with SIRS, mild sepsis, severe sepsis.

Figure 146:
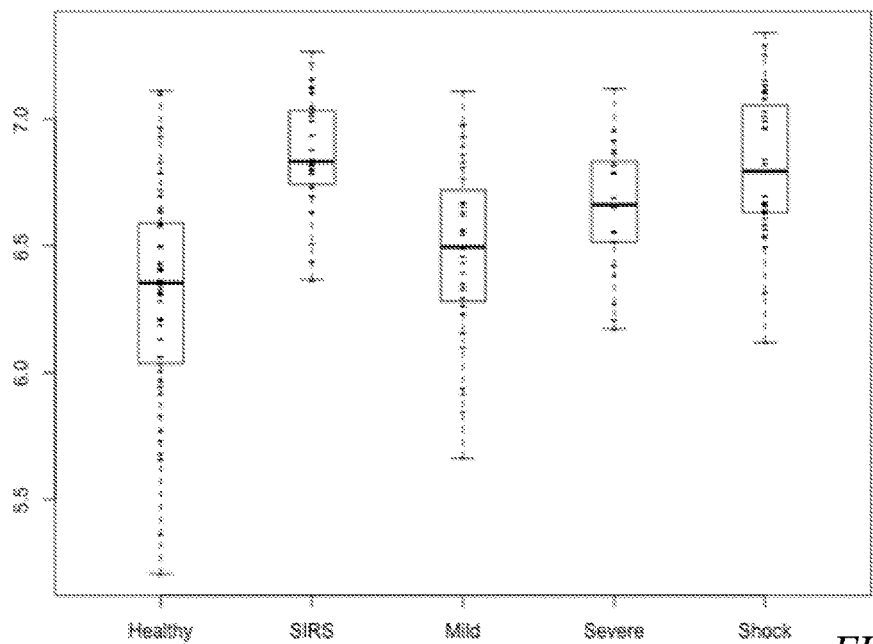

FIG. 146 shows a box and whiskers plot of HIST1H2AA gene expression for healthy subjects and subjects with SIRS, mild sepsis, severe sepsis.

Figure 147:
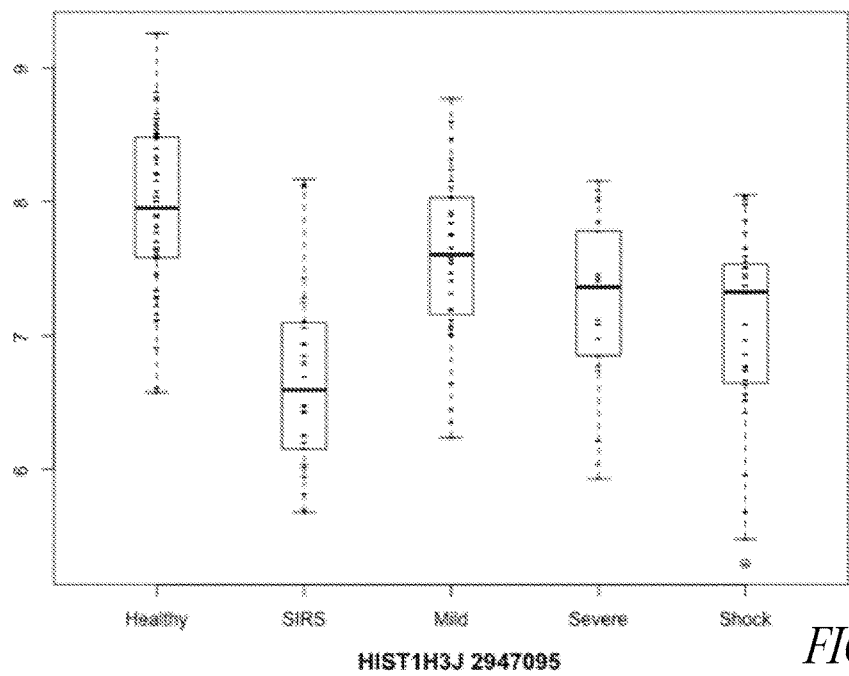

FIG. 147 shows a box and whiskers plot of HINT1 gene expression for healthy subjects and subjects with SIRS, mild sepsis, severe sepsis.

Figure 148:
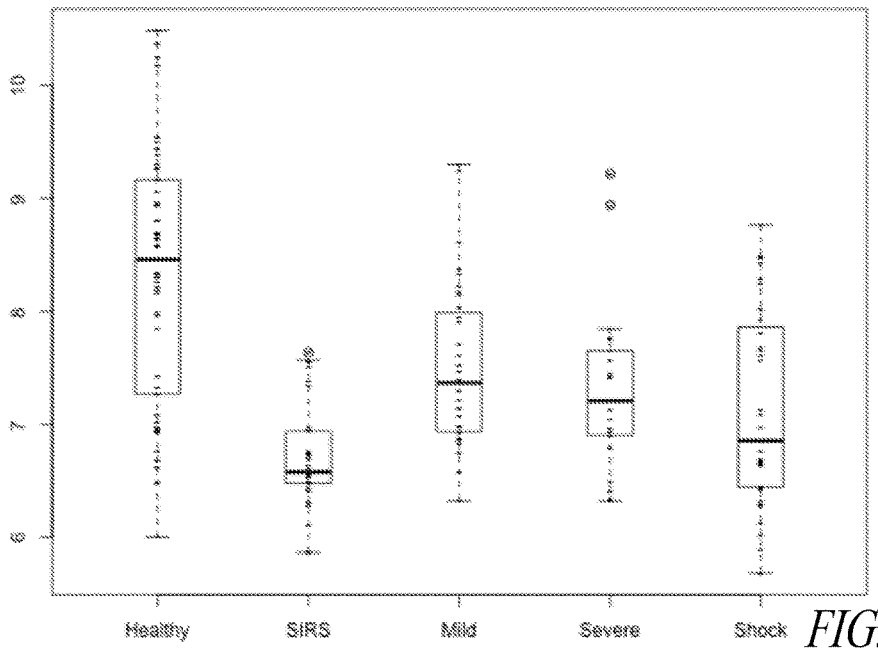

FIG. 148 shows a box and whiskers plot of HIST1H3J gene expression for healthy subjects and subjects with SIRS, mild sepsis, severe sepsis.

Figure 149:
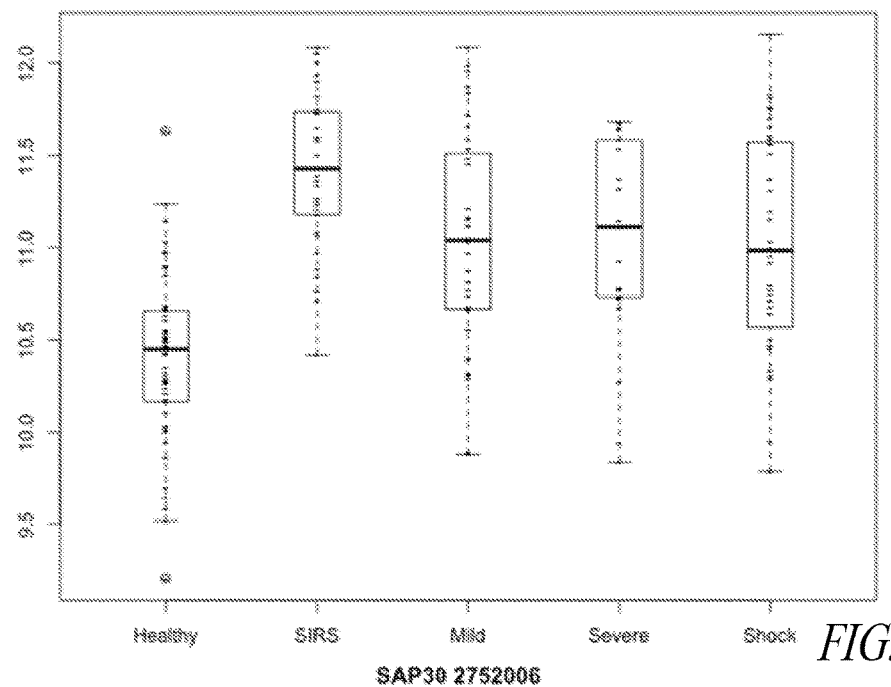

FIG. 149 shows a box and whiskers plot of CDA gene expression for healthy subjects and subjects with SIRS, mild sepsis, severe sepsis.

Figure 150:
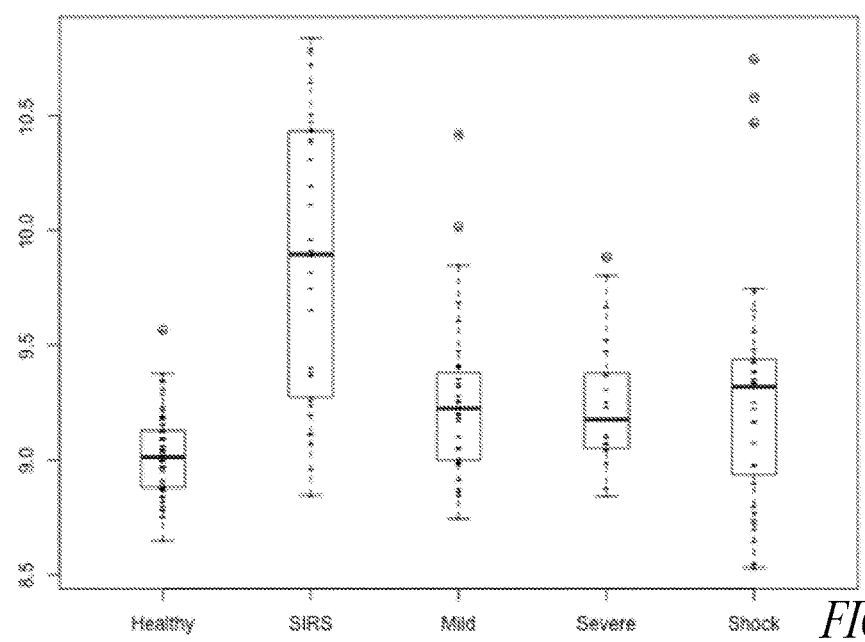

FIG. 150 shows a box and whiskers plot of SAP30 gene expression for healthy subjects and subjects with SIRS, mild sepsis, severe sepsis.

Figure 151:
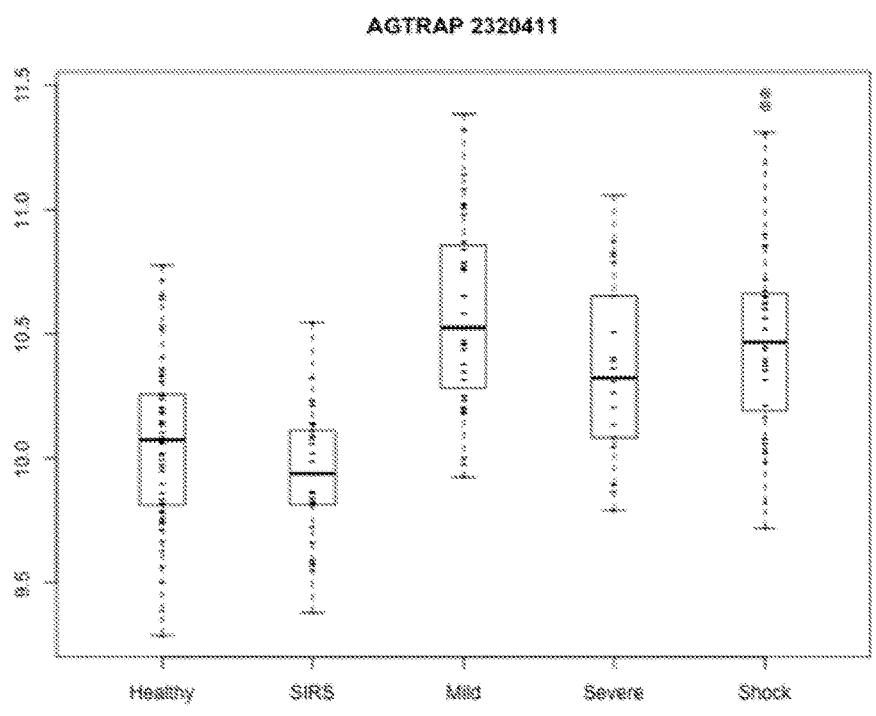

FIG. 151 shows a box and whiskers plot of AGTRAP gene expression for healthy subjects and subjects with SIRS, mild sepsis, severe sepsis.

Figure 152:
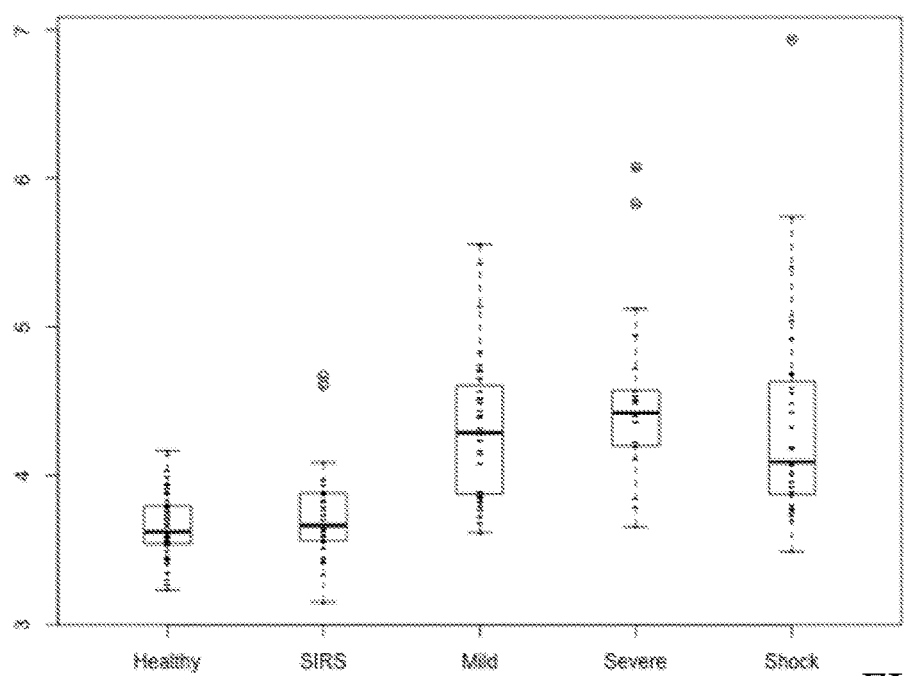

FIG. 152 shows a box and whiskers plot of SUCNR1 gene expression for healthy subjects and subjects with SIRS, mild sepsis, severe sepsis.

Figure 153:
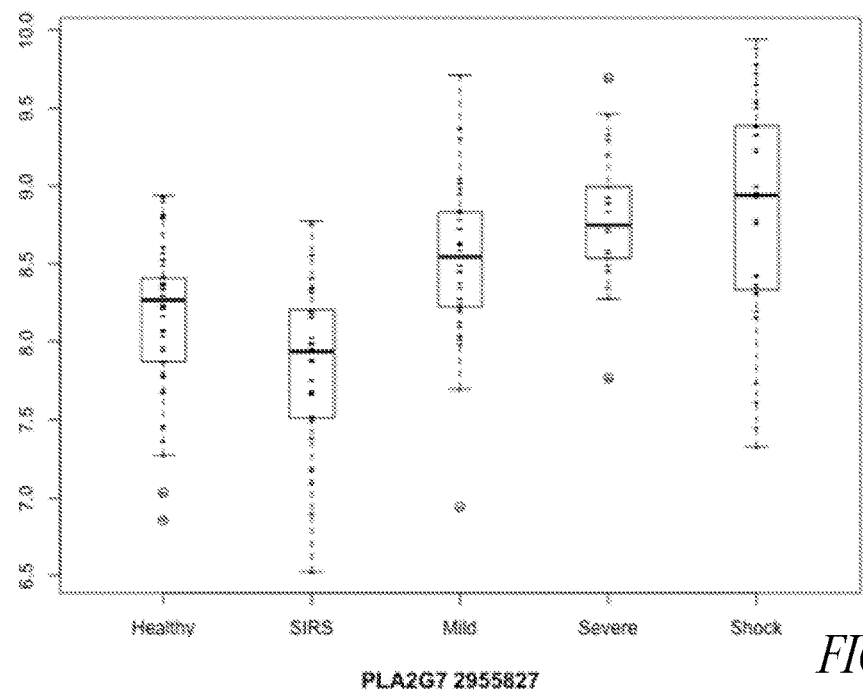

FIG. 153 shows a box and whiskers plot of MTRR gene expression for healthy subjects and subjects with SIRS, mild sepsis, severe sepsis.

Figure 154:
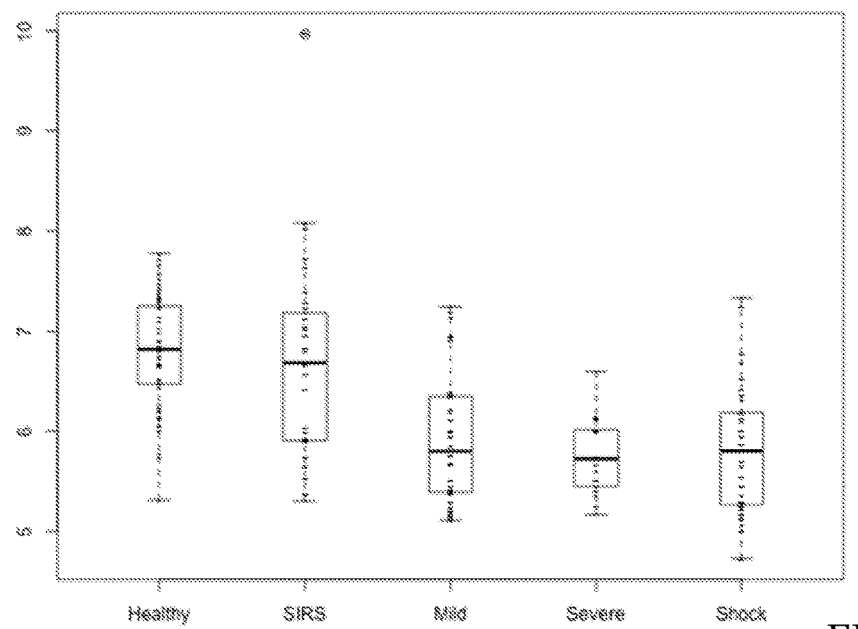

FIG. 154 shows a box and whiskers plot of PLA2G7 gene expression for healthy subjects and subjects with SIRS, mild sepsis, severe sepsis.

Figure 155:
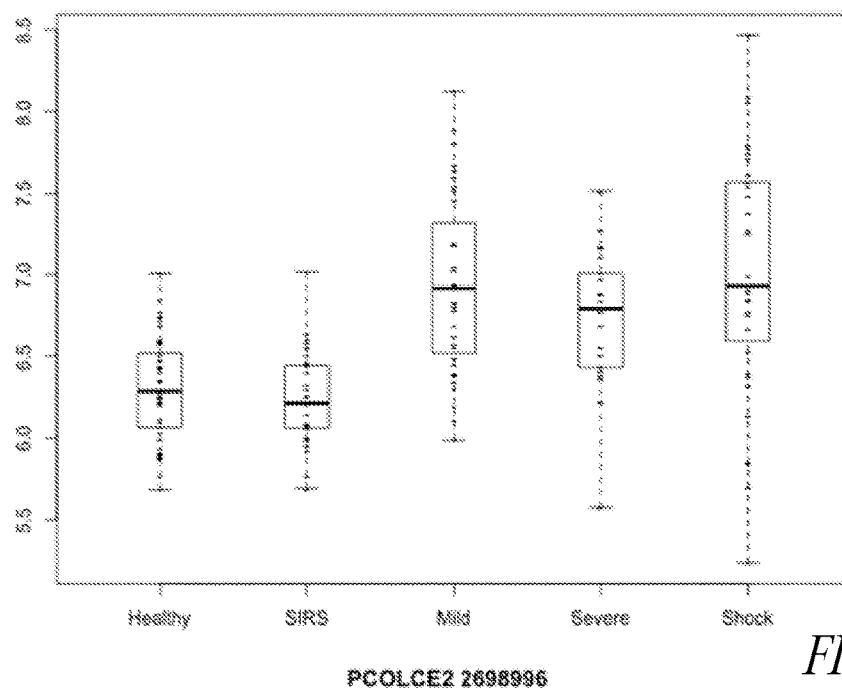

FIG. 155 shows a box and whiskers plot of AIG1 gene expression for healthy subjects and subjects with SIRS, mild sepsis, severe sepsis.

Figure 156:
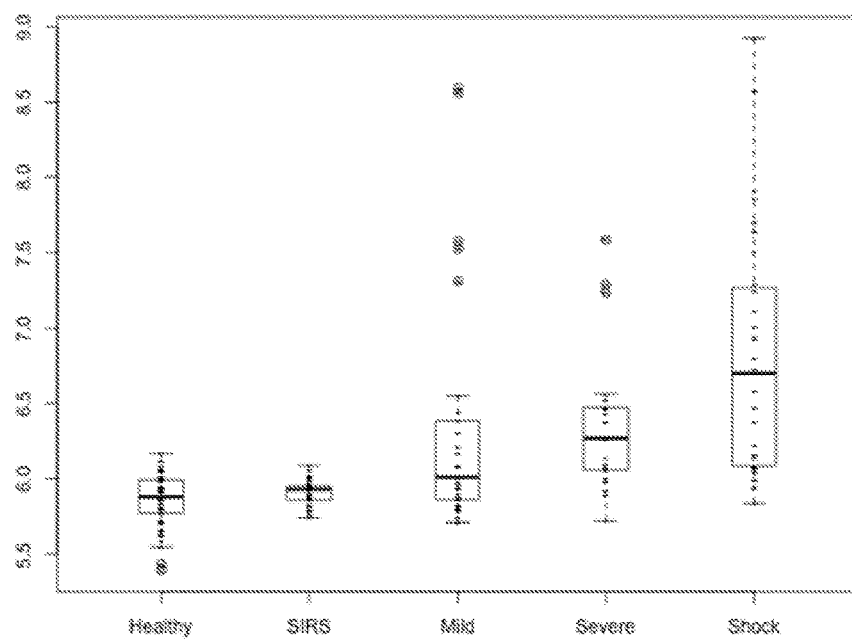

FIG. 156 shows a box and whiskers plot of PCOLCE2 gene expression for healthy subjects and subjects with SIRS, mild sepsis, severe sepsis.

Figure 157:
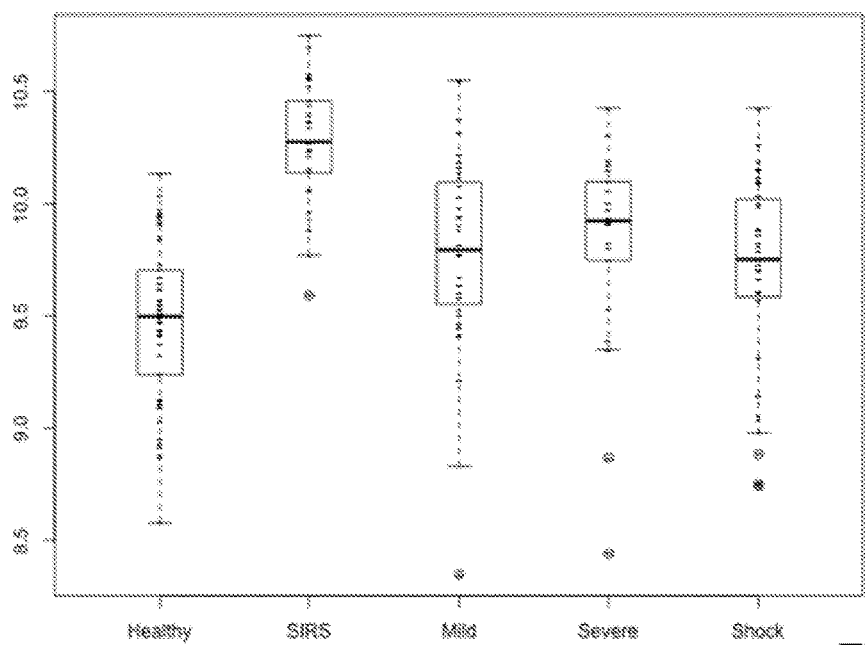

FIG. 157 shows a box and whiskers plot of GAB2 gene expression for healthy subjects and subjects with SIRS, mild sepsis, severe sepsis.

Figure 158:
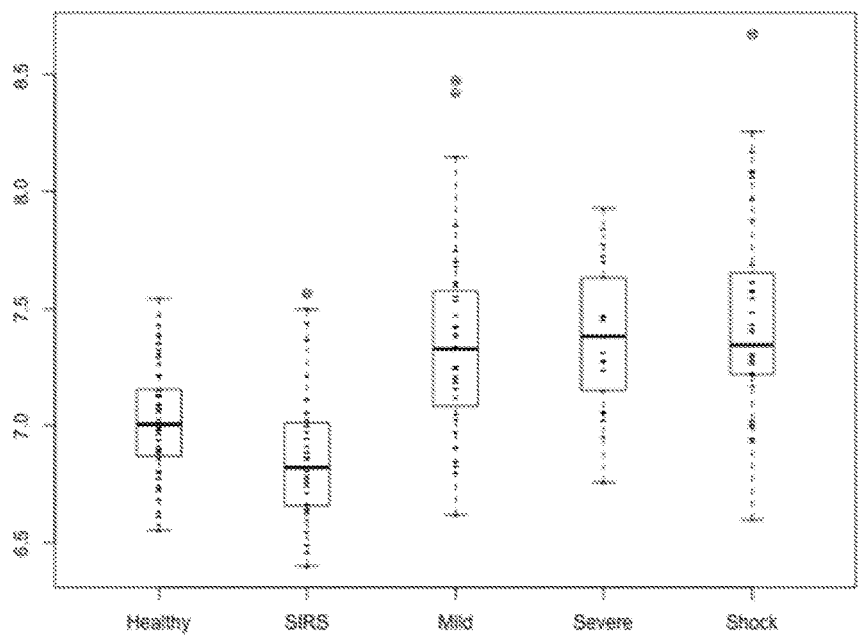

FIG. 158 shows a box and whiskers plot of HS2ST1//UBA2 gene expression for healthy subjects and subjects with SIRS, mild sepsis, severe sepsis.

Figure 159:
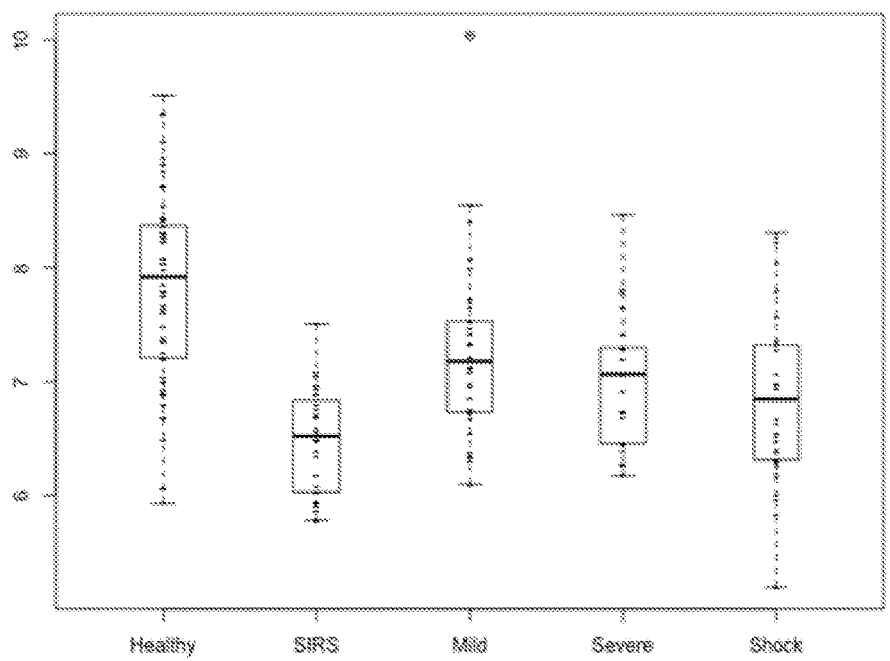

FIG. 159 shows a box and whiskers plot of HIST1H3A gene expression for healthy subjects and subjects with SIRS, mild sepsis, severe sepsis.

Figure 160:
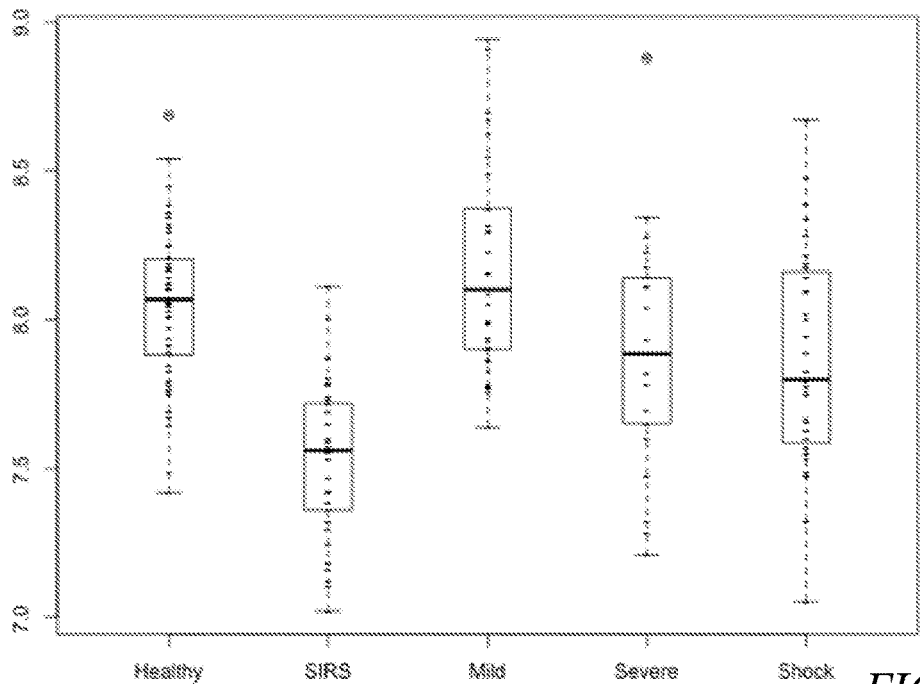

FIG. 160 shows a box and whiskers plot of C22orf37 gene expression for healthy subjects and subjects with SIRS, mild sepsis, severe sepsis.

Figure 161:
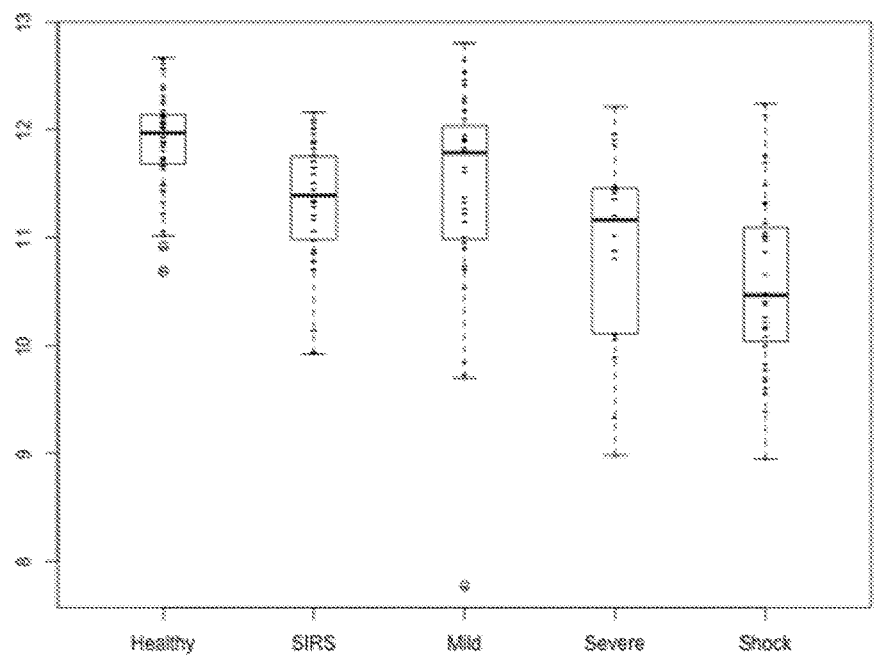

FIG. 161 shows a box and whiskers plot of HLA-DPA1 gene expression for healthy subjects and subjects with SIRS, mild sepsis, severe sepsis.

Figure 162:
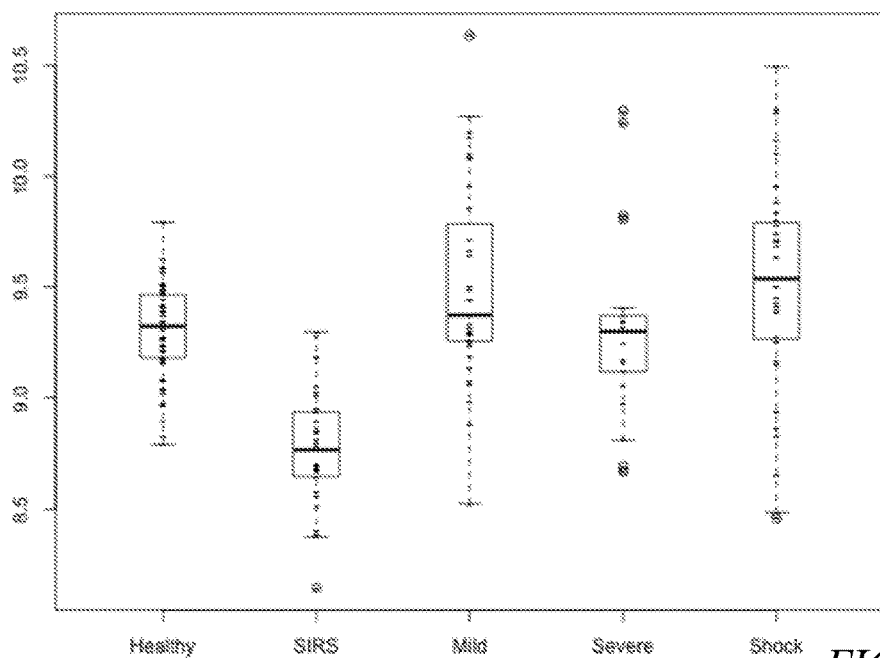

FIG. 162 shows a box and whiskers plot of VOPP1//LOC100128019 gene expression for healthy subjects and subjects with SIRS, mild sepsis, severe sepsis.

Figure 163:
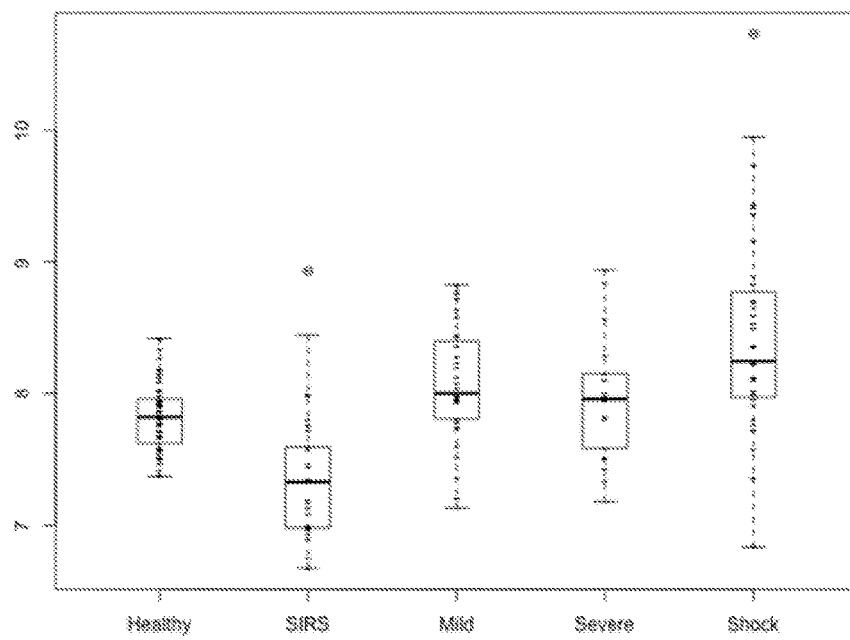

FIG. 163 shows a box and whiskers plot of SLC39A8 gene expression for healthy subjects and subjects with SIRS, mild sepsis, severe sepsis.

Figure 164:
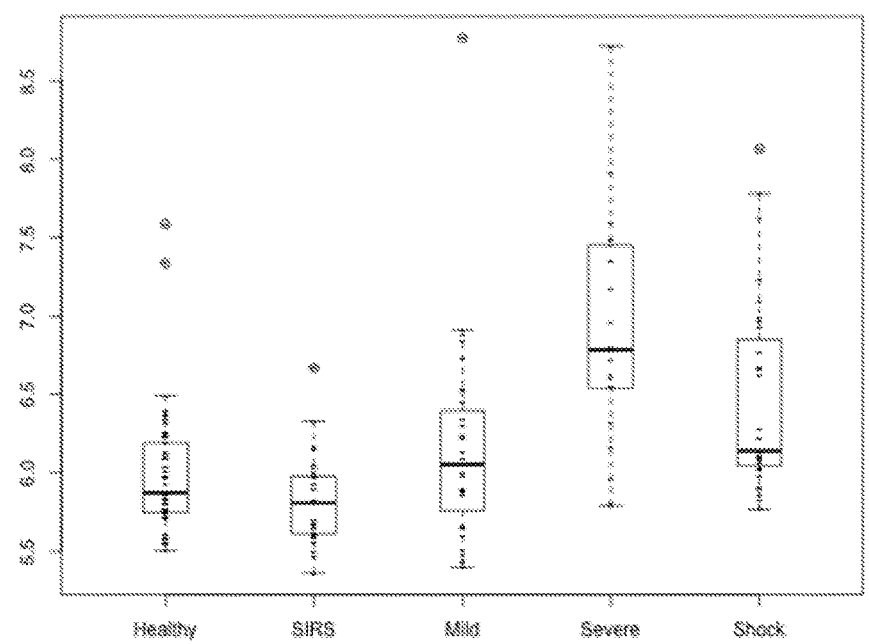

FIG. 164 shows a box and whiskers plot of MKI67 gene expression for healthy subjects and subjects with SIRS, mild sepsis, severe sepsis.

Figure 165:
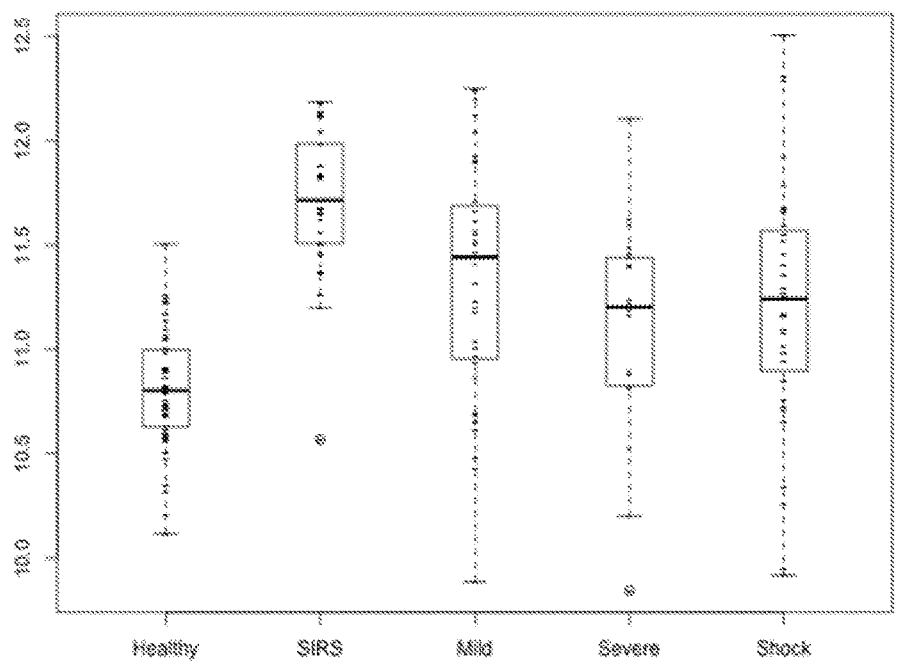

FIG. 165 shows a box and whiskers plot of SLC11A1 gene expression for healthy subjects and subjects with SIRS, mild sepsis, severe sepsis.

Figure 166:
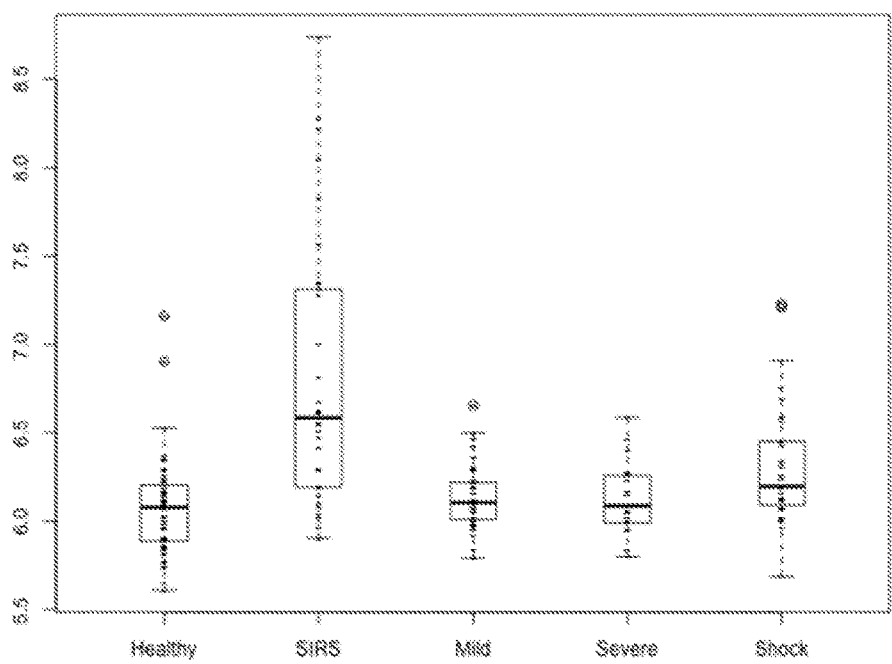

FIG. 166 shows a box and whiskers plot of AREG gene expression for healthy subjects and subjects with SIRS, mild sepsis, severe sepsis.

Figure 167:
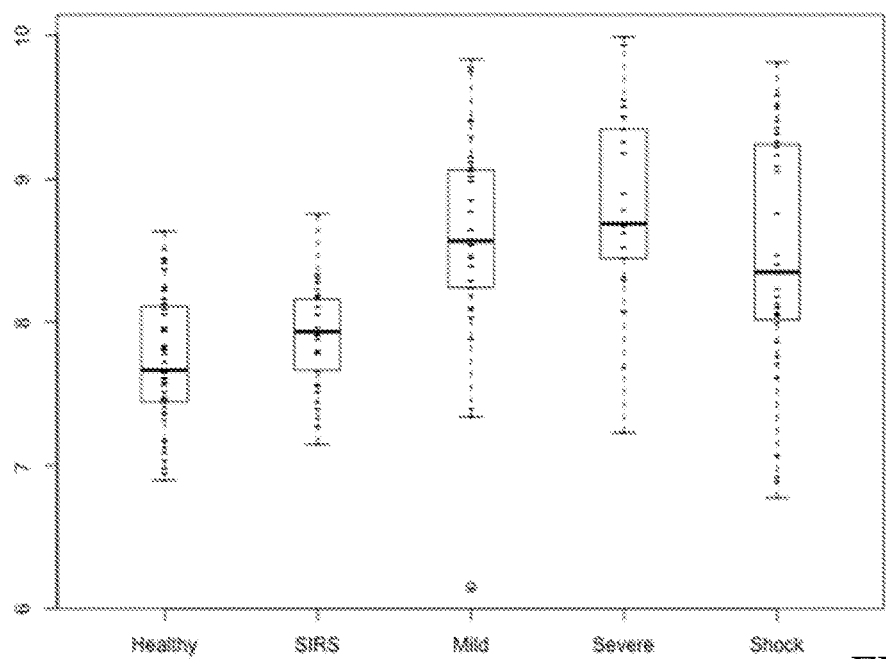

FIG. 167 shows a box and whiskers plot of ABCA1 gene expression for healthy subjects and subjects with SIRS, mild sepsis, severe sepsis.

Figure 168:
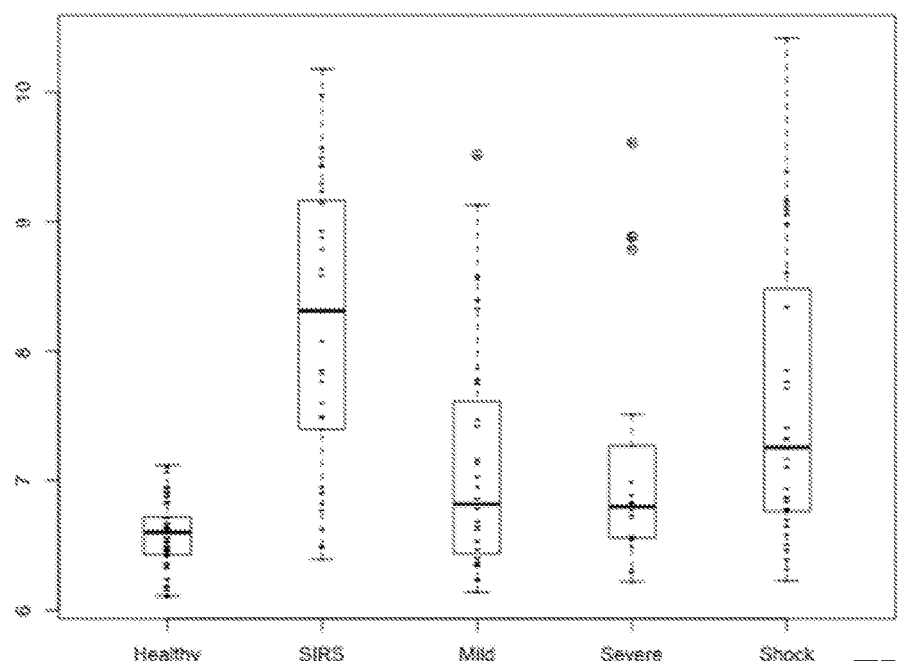

FIG. 168 shows a box and whiskers plot of DAAM2//LOC100131657 gene expression for healthy subjects and subjects with SIRS, mild sepsis, severe sepsis.

Figure 169:
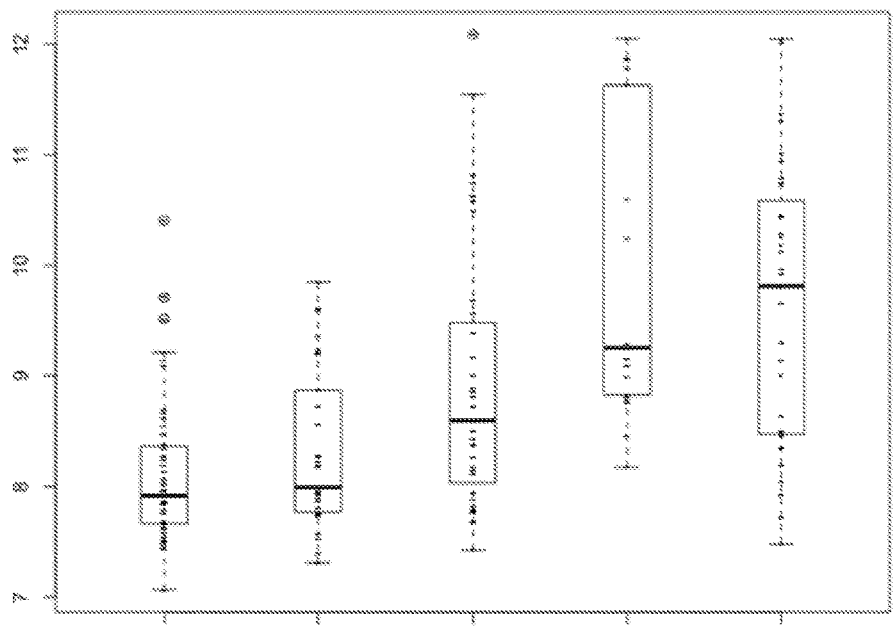

FIG. 169 shows a box and whiskers plot of LTF gene expression for healthy subjects and subjects with SIRS, mild sepsis, severe sepsis.

Figure 170:
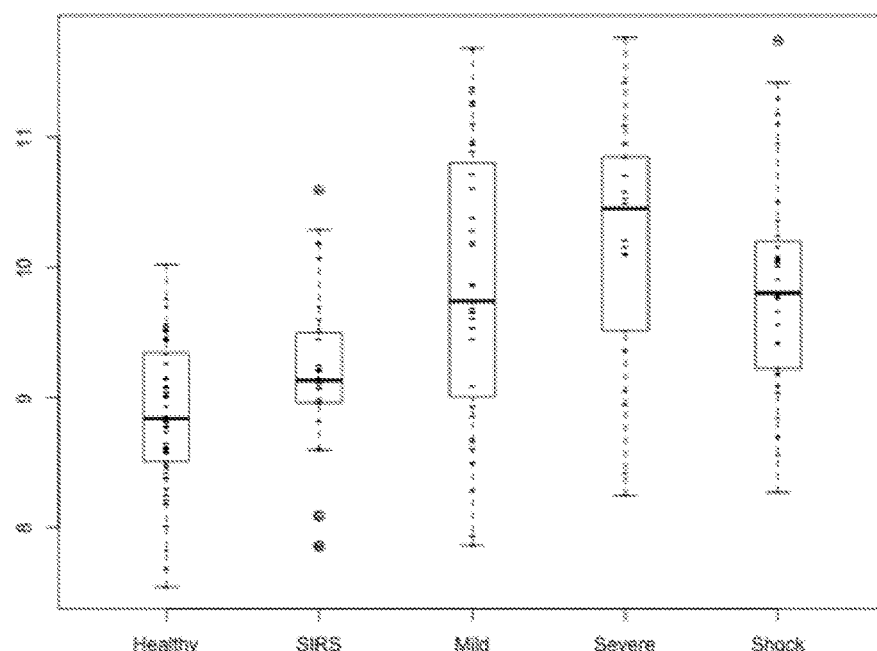

FIG. 170 shows a box and whiskers plot of TREML1 gene expression for healthy subjects and subjects with SIRS, mild sepsis, severe sepsis.

Figure 171:
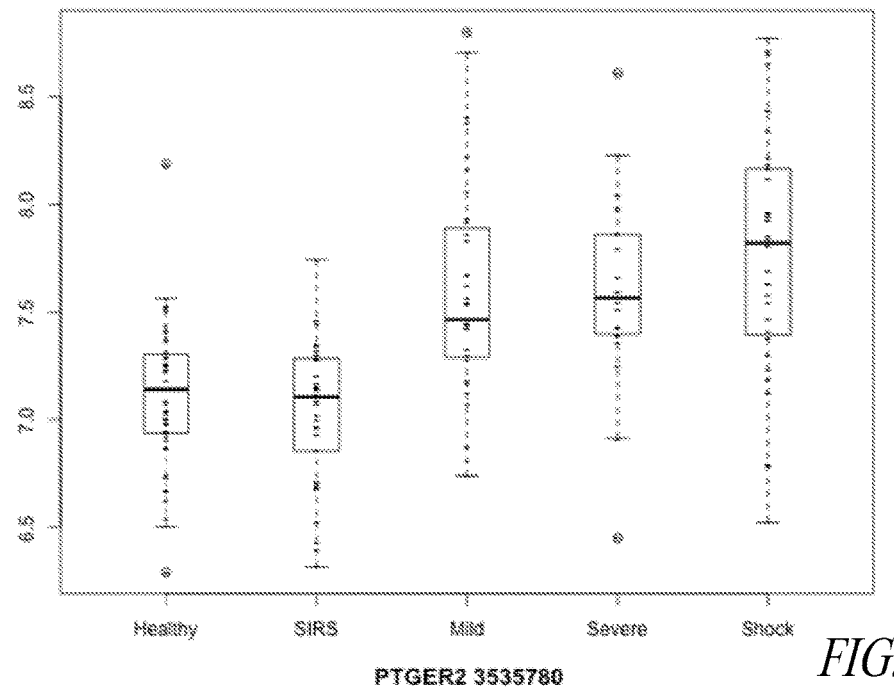

FIG. 171 shows a box and whiskers plot of GSTO1 gene expression for healthy subjects and subjects with SIRS, mild sepsis, severe sepsis.

Figure 172:
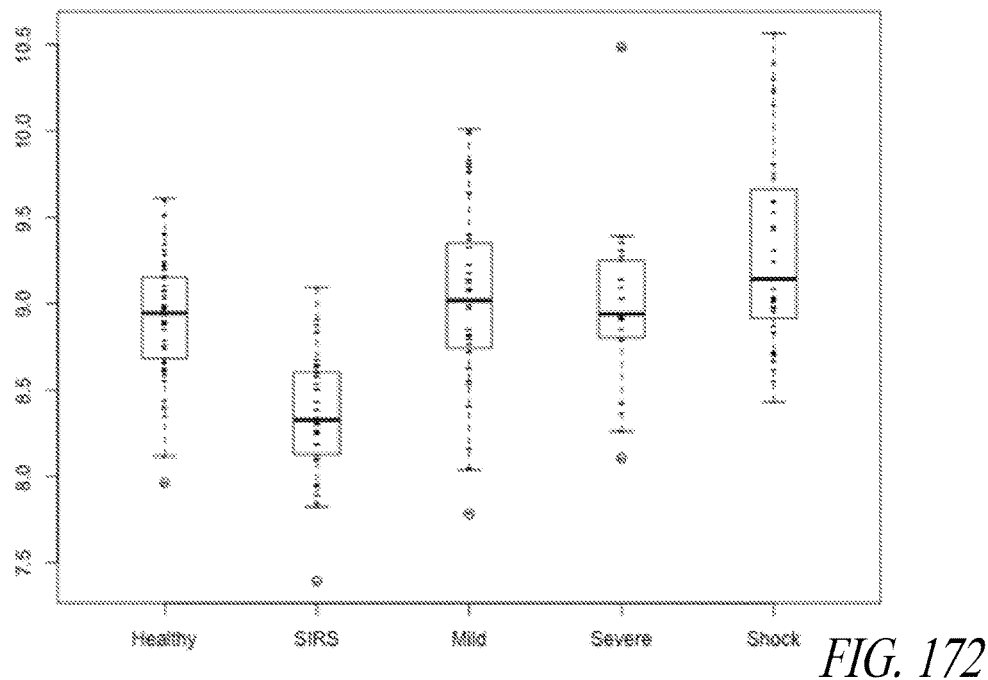

FIG. 172 shows a box and whiskers plot of PTGER2 gene expression for healthy subjects and subjects with SIRS, mild sepsis, severe sepsis.

Figure 173:
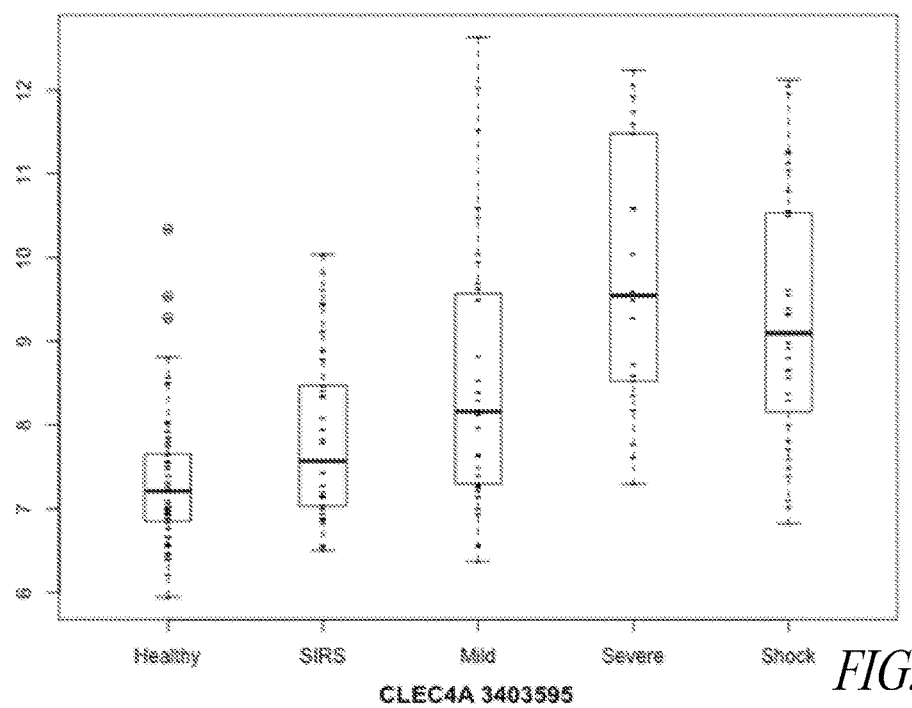

FIG. 173 shows a box and whiskers plot of CEACAM8 gene expression for healthy subjects and subjects with SIRS, mild sepsis, severe sepsis.

Figure 174:
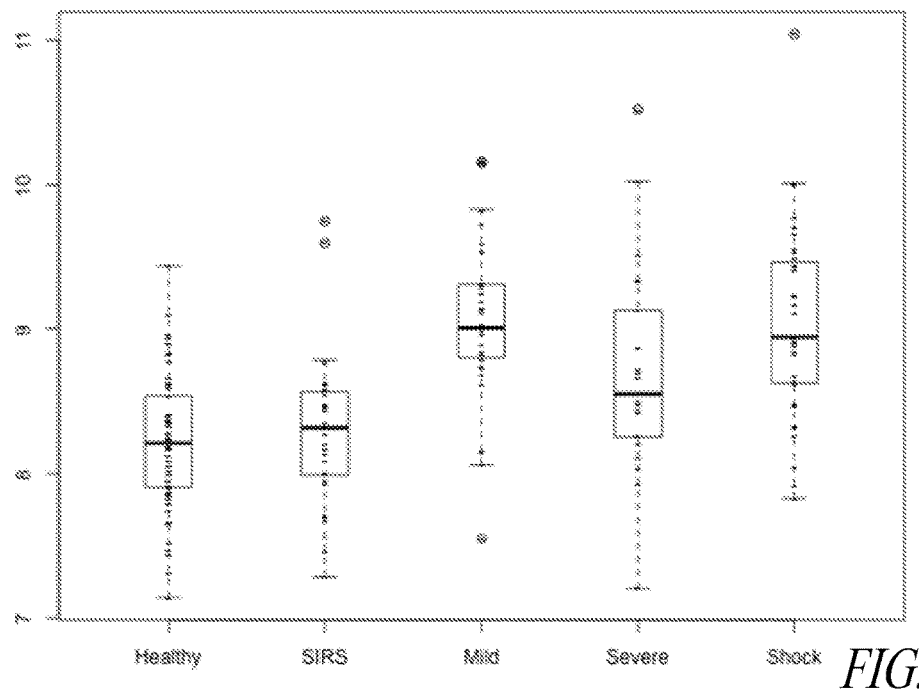

FIG. 174 shows a box and whiskers plot of CLEC4A gene expression for healthy subjects and subjects with SIRS, mild sepsis, severe sepsis.

Figure 175:
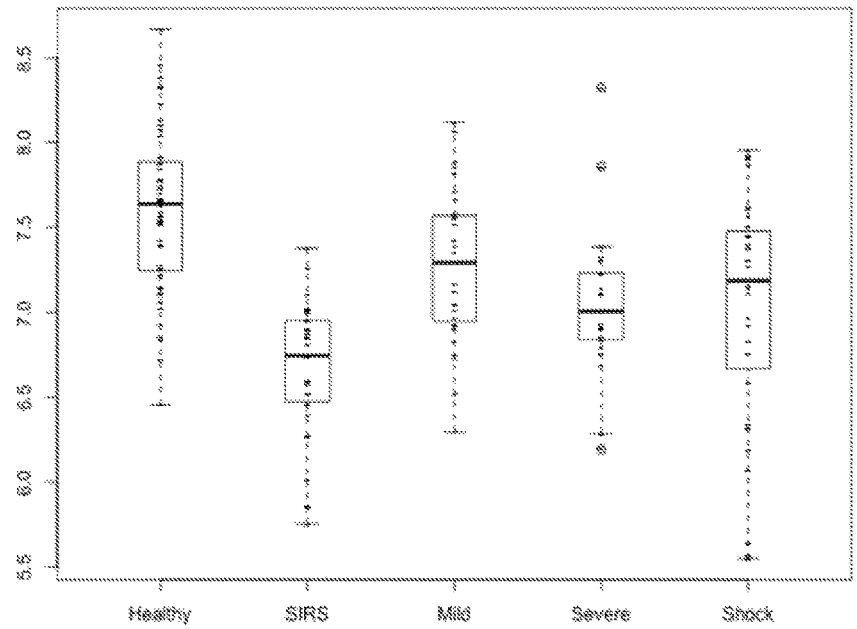

FIG. 175 shows a box and whiskers plot of PMS2CL/PMS2 gene expression for healthy subjects and subjects with SIRS, mild sepsis, severe sepsis.

Figure 176:
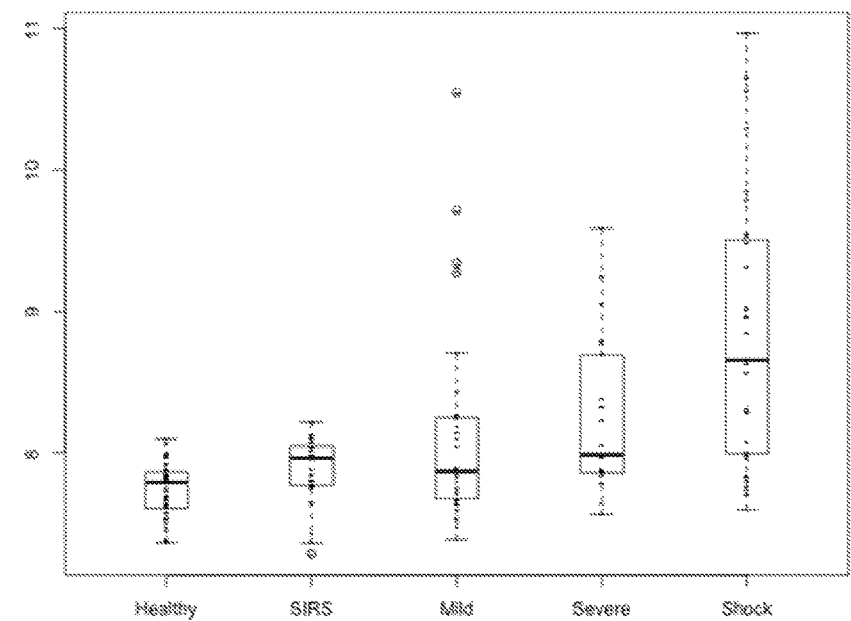

FIG. 176 shows a box and whiskers plot of RETN gene expression for healthy subjects and subjects with SIRS, mild sepsis, severe sepsis.

Figure 177:
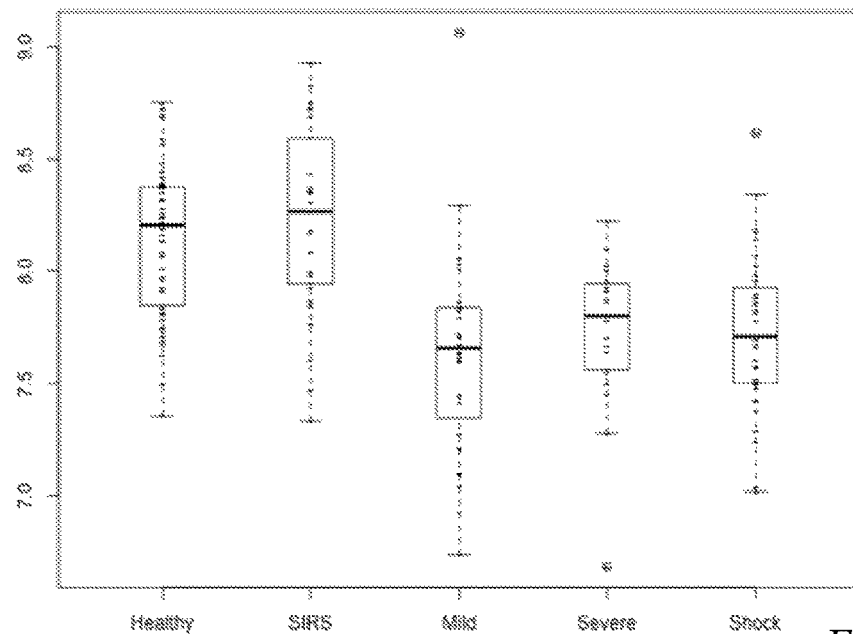

FIG. 177 shows a box and whiskers plot of PDE3B gene expression for healthy subjects and subjects with SIRS, mild sepsis, severe sepsis.

Figure 178:
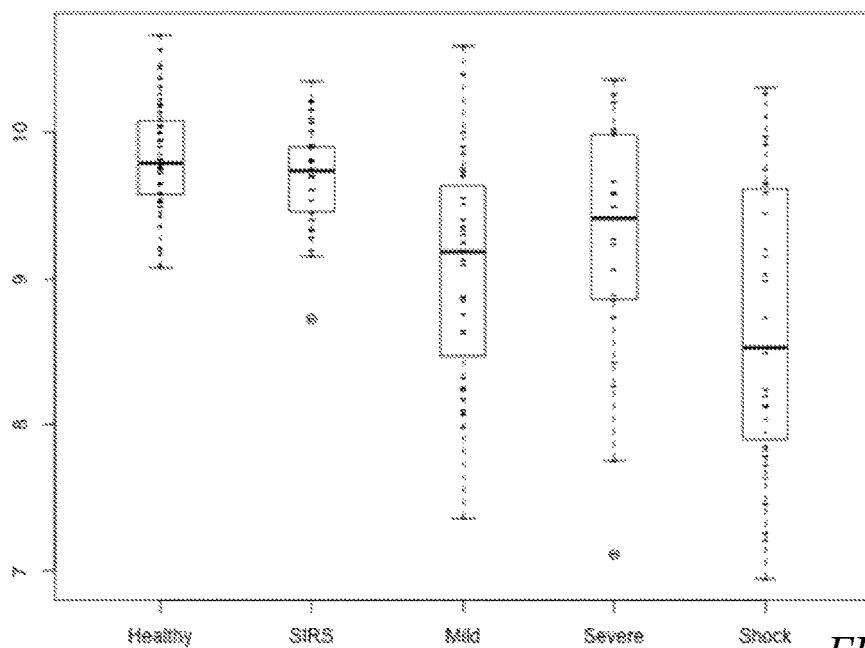

FIG. 178 shows a box and whiskers plot of SULF2 gene expression for healthy subjects and subjects with SIRS, mild sepsis, severe sepsis.

Figure 179:
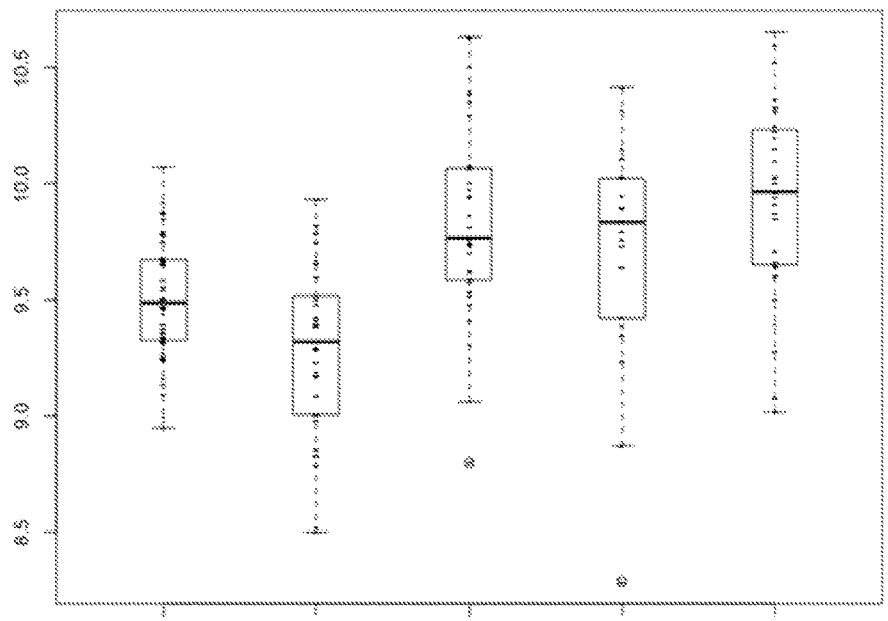

FIG. 179 shows a box and whiskers plot of NEK6//LOC100129034 gene expression for healthy subjects and subjects with SIRS, mild sepsis, severe sepsis.

Figure 180:
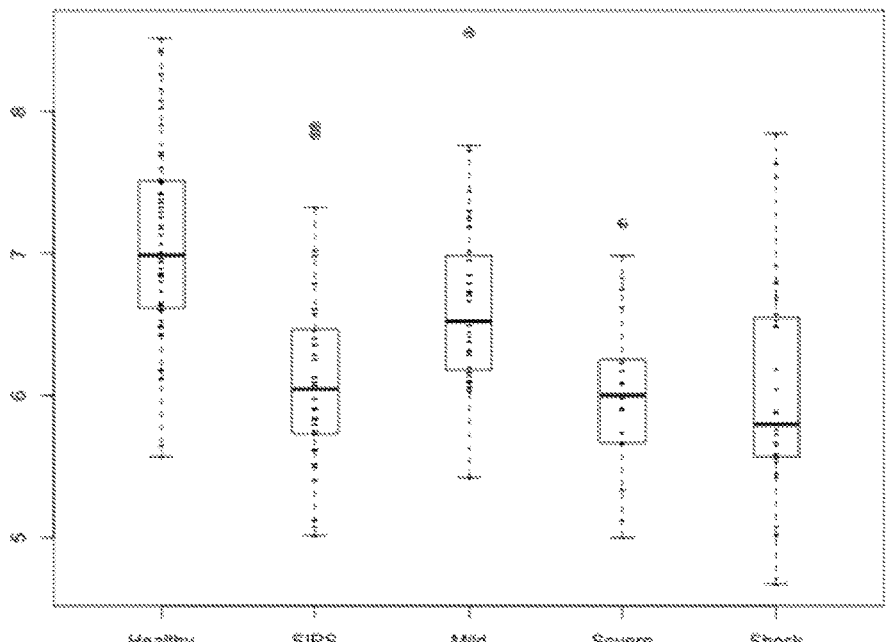

FIG. 180 shows a box and whiskers plot of CENPK gene expression for healthy subjects and subjects with SIRS, mild sepsis, severe sepsis.

Figure 181:
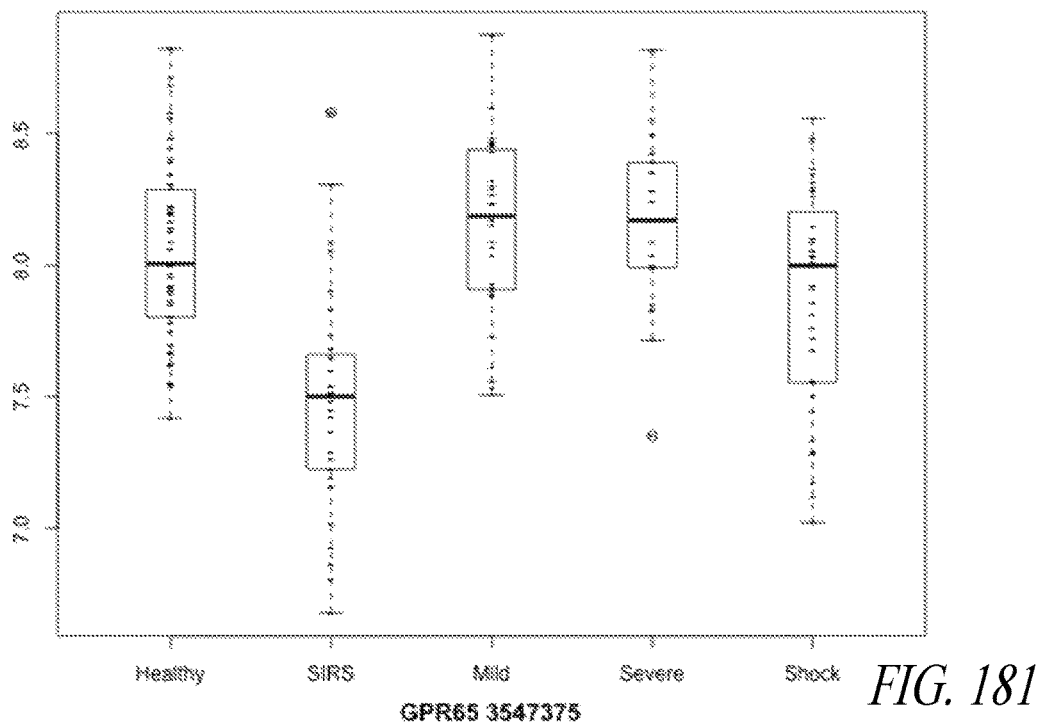

FIG. 181 shows a box and whiskers plot of TRAF3 gene expression for healthy subjects and subjects with SIRS, mild sepsis, severe sepsis.

Figure 182:
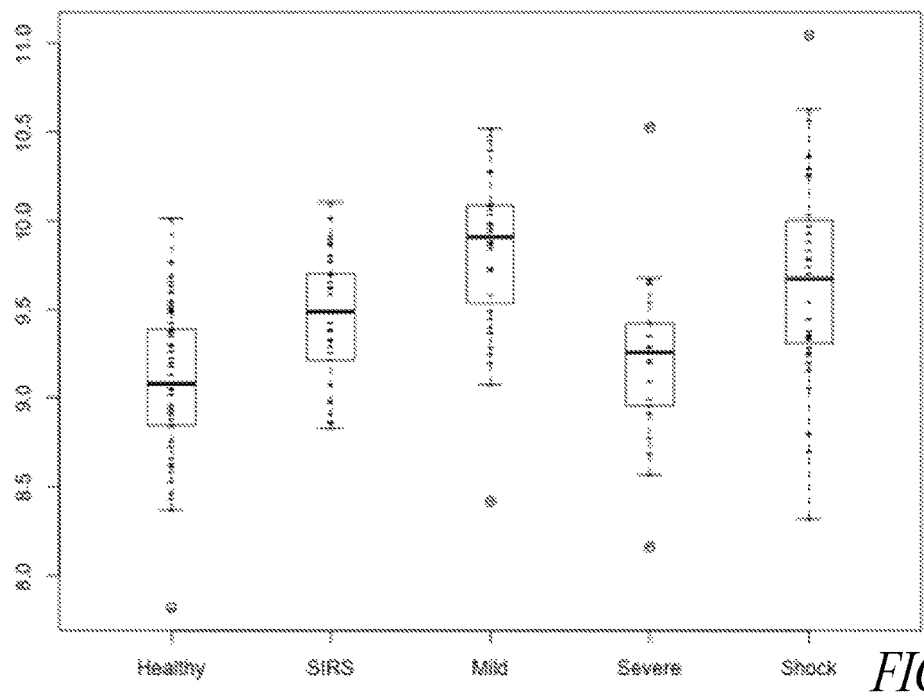

FIG. 182 shows a box and whiskers plot of GPR65 gene expression for healthy subjects and subjects with SIRS, mild sepsis, severe sepsis.

Figure 183:
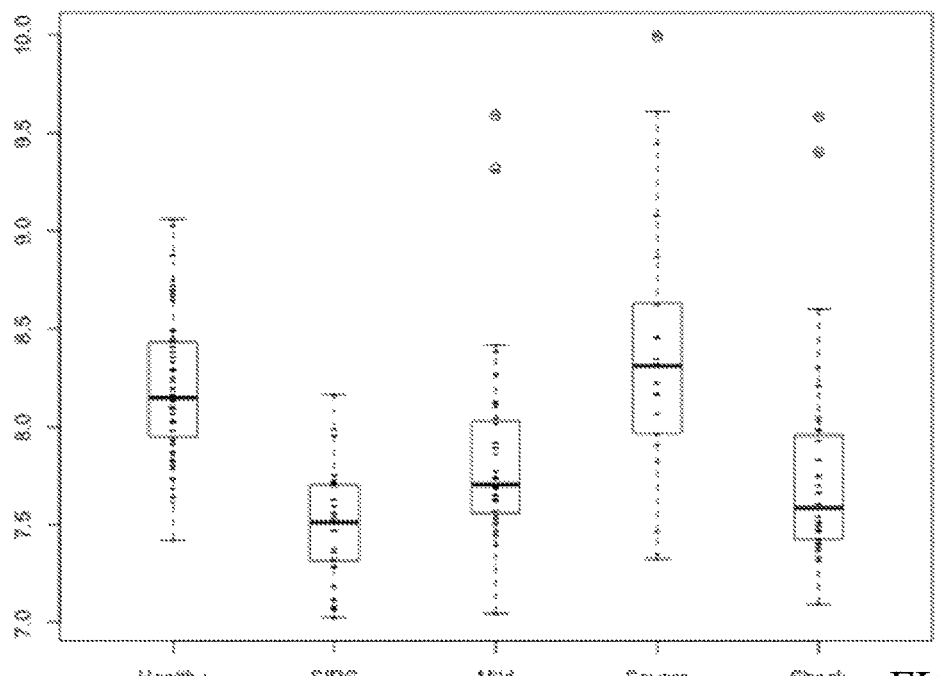

FIG. 183 shows a box and whiskers plot of IRF4 gene expression for healthy subjects and subjects with SIRS, mild sepsis, severe sepsis.

Figure 184:
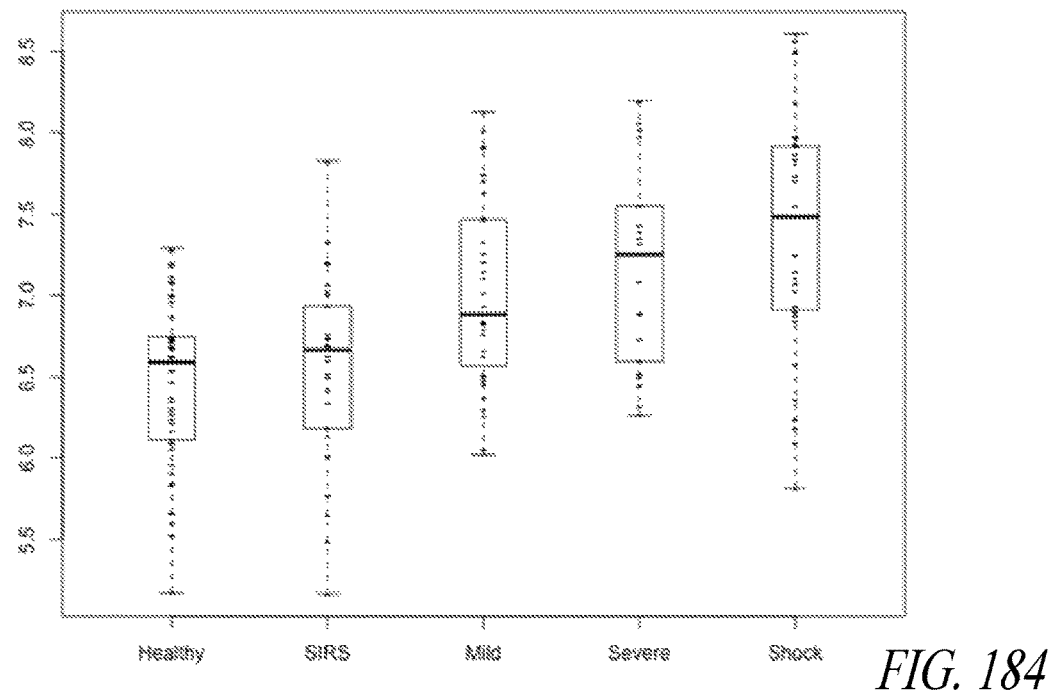

FIG. 184 shows a box and whiskers plot of MACF1 gene expression for healthy subjects and subjects with SIRS, mild sepsis, severe sepsis.

Figure 185:
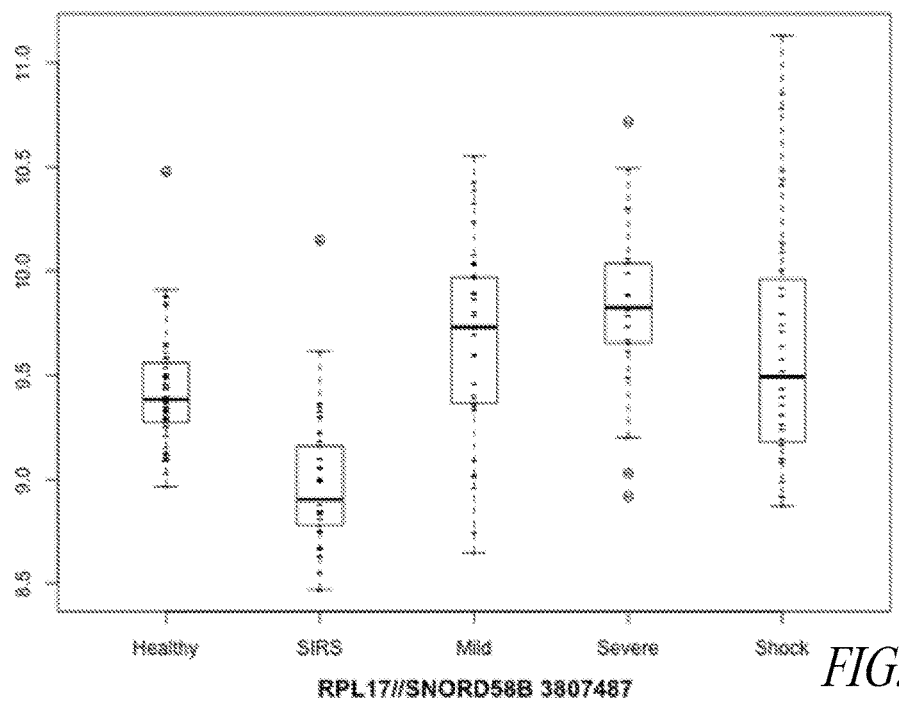

FIG. 185 shows a box and whiskers plot of AMFR gene expression for healthy subjects and subjects with SIRS, mild sepsis, severe sepsis.

Figure 186:
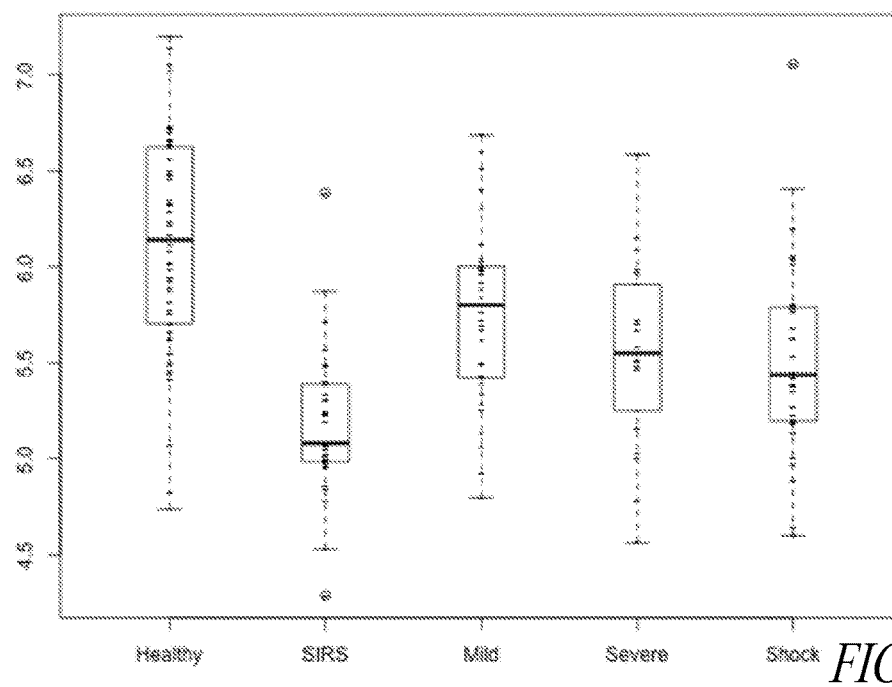

FIG. 186 shows a box and whiskers plot of RPL17//SNORD58B gene expression for healthy subjects and subjects with SIRS, mild sepsis, severe sepsis.

Figure 187:
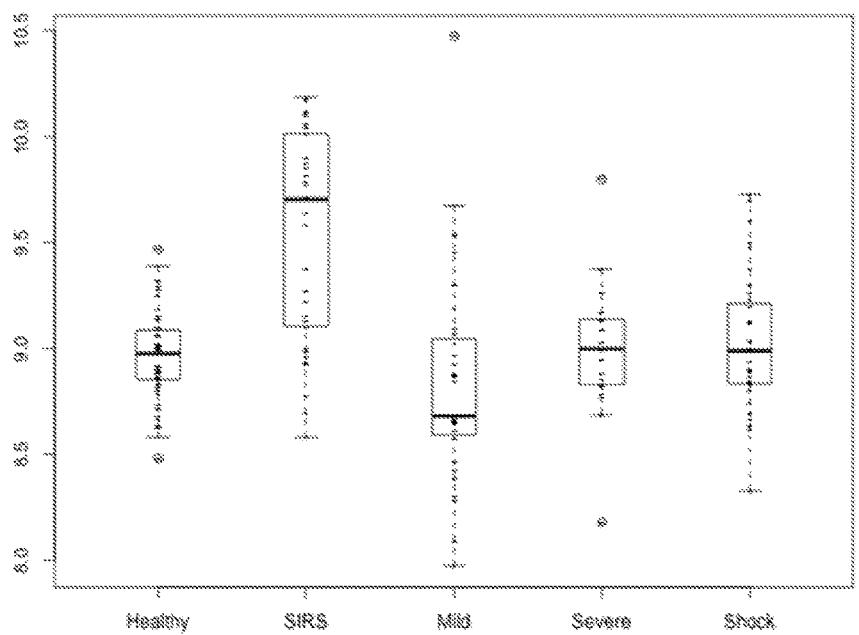

FIG. 187 shows a box and whiskers plot of IRS2 gene expression for healthy subjects and subjects with SIRS, mild sepsis, severe sepsis.

Figure 188:
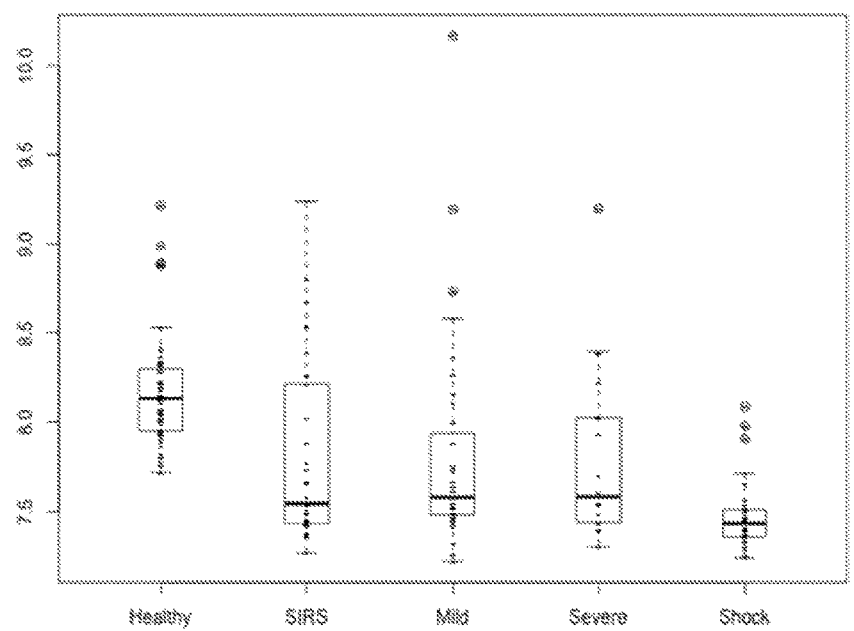

FIG. 188 shows a box and whiskers plot of JUP gene expression for healthy subjects and subjects with SIRS, mild sepsis, severe sepsis.

Figure 189:
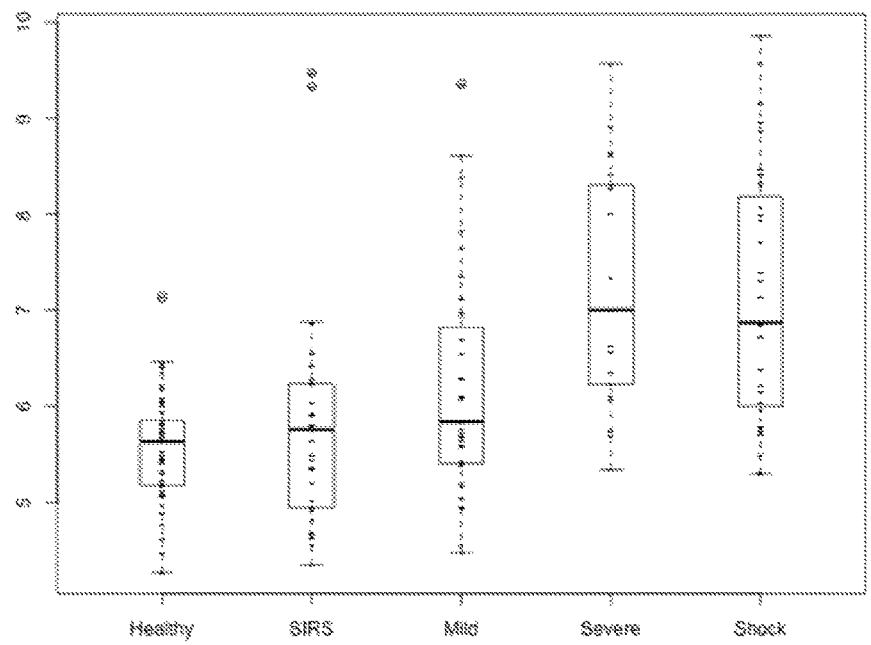

FIG. 189 shows a box and whiskers plot of CD24 gene expression for healthy subjects and subjects with SIRS, mild sepsis, severe sepsis.

Figure 190:
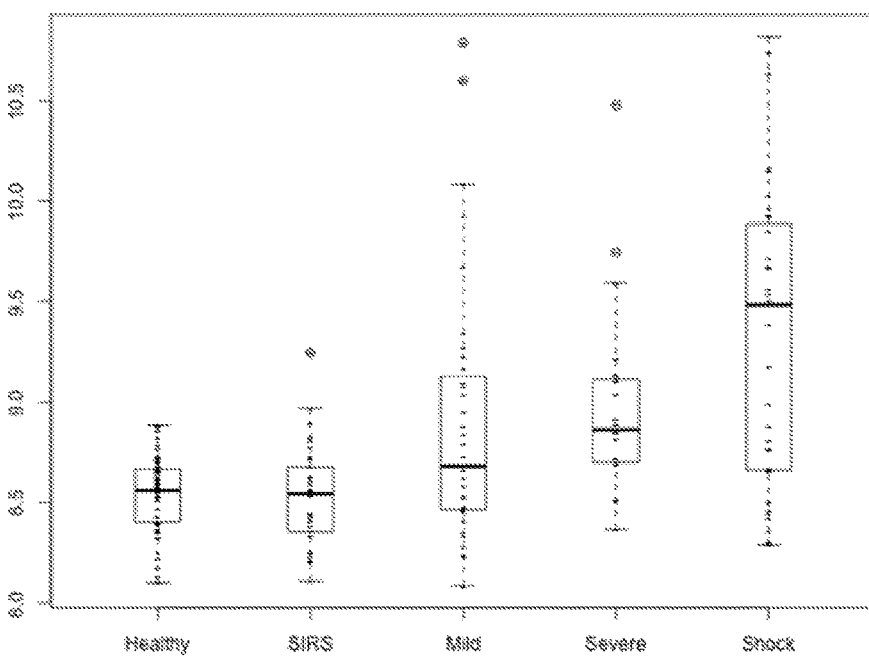

FIG. 190 shows a box and whiskers plot of GALNT2 gene expression for healthy subjects and subjects with SIRS, mild sepsis, severe sepsis.

Figure 191:
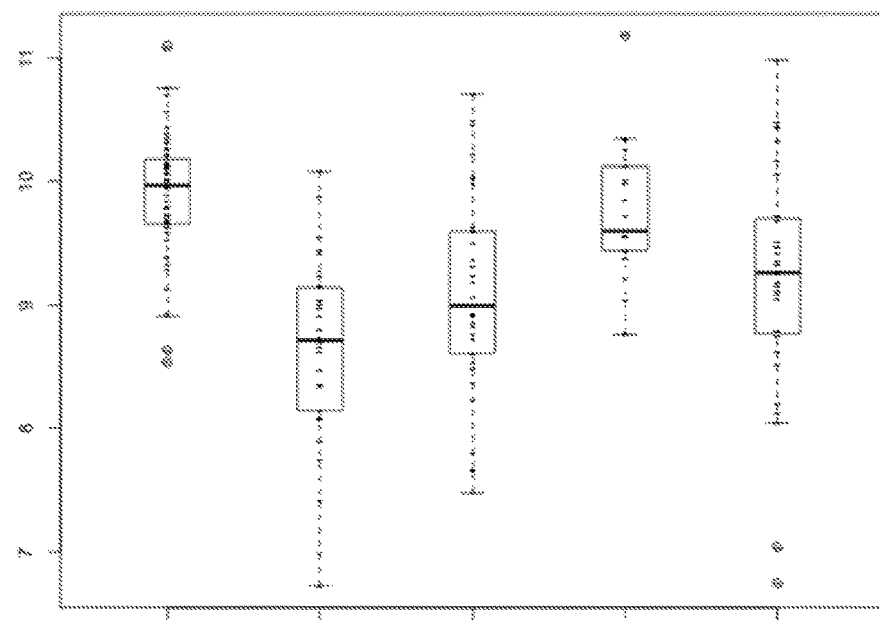

FIG. 191 shows a box and whiskers plot of HSP90AB1//HSP90AB3P//HSP90AB2P gene expression for healthy subjects and subjects with SIRS, mild sepsis, severe sepsis.

Figure 192:
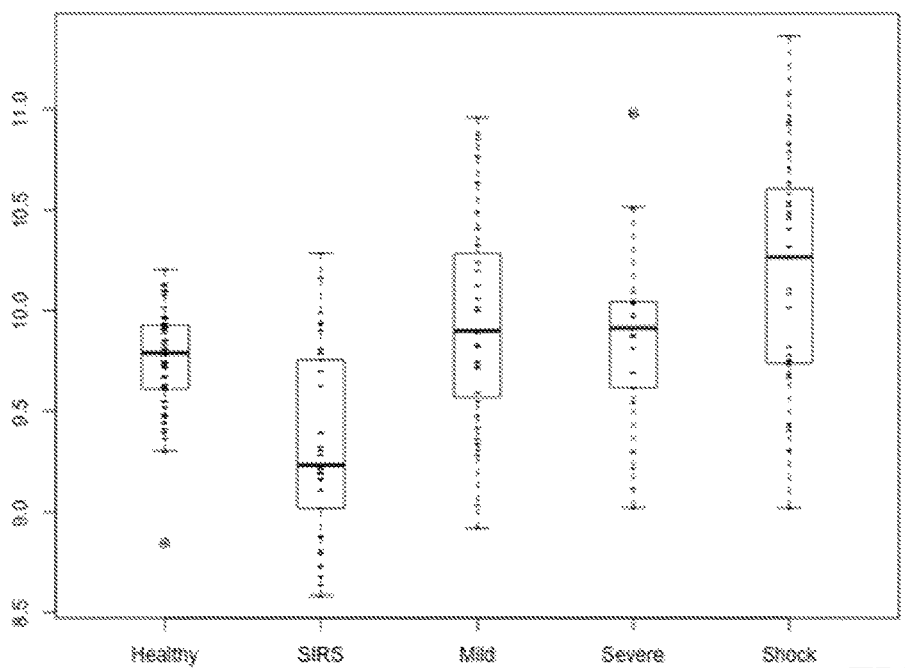

FIG. 192 shows a box and whiskers plot of GLT25D1 gene expression for healthy subjects and subjects with SIRS, mild sepsis, severe sepsis.

Figure 193:
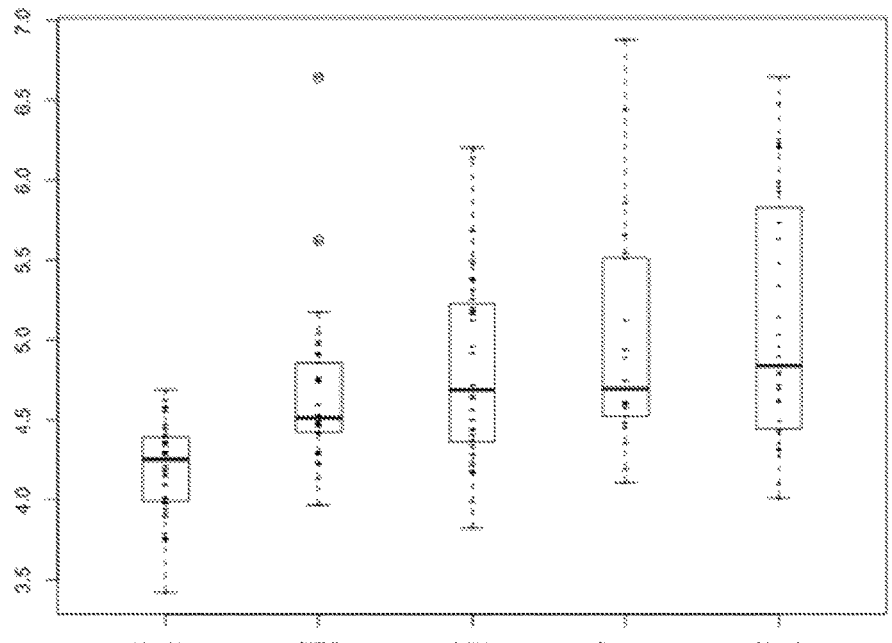

FIG. 193 shows a box and whiskers plot of OR9A2 gene expression for healthy subjects and subjects with SIRS, mild sepsis, severe sepsis.

Figure 194:
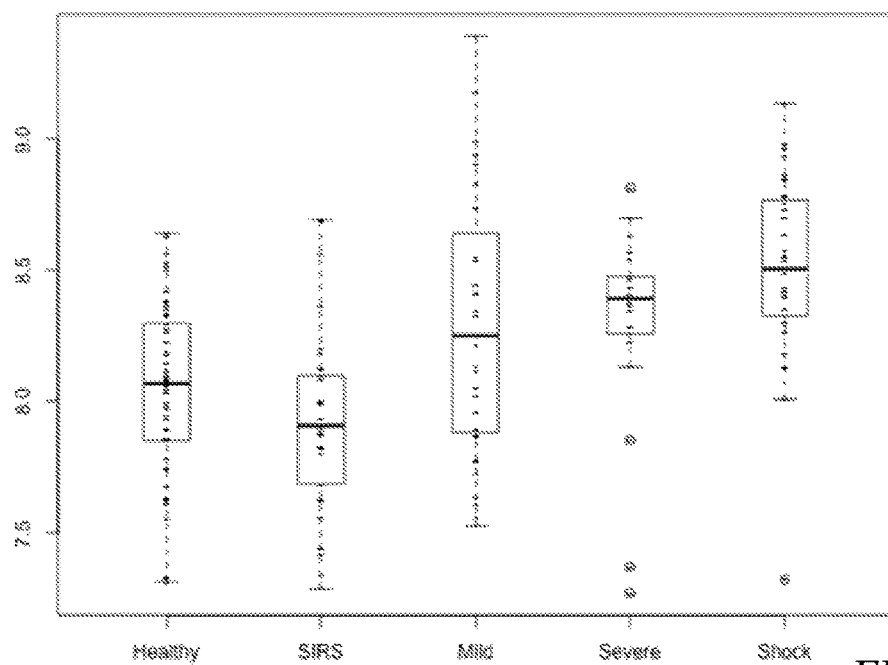

FIG. 194 shows a box and whiskers plot of HDHD1A gene expression for healthy subjects and subjects with SIRS, mild sepsis, severe sepsis.

Figure 195:
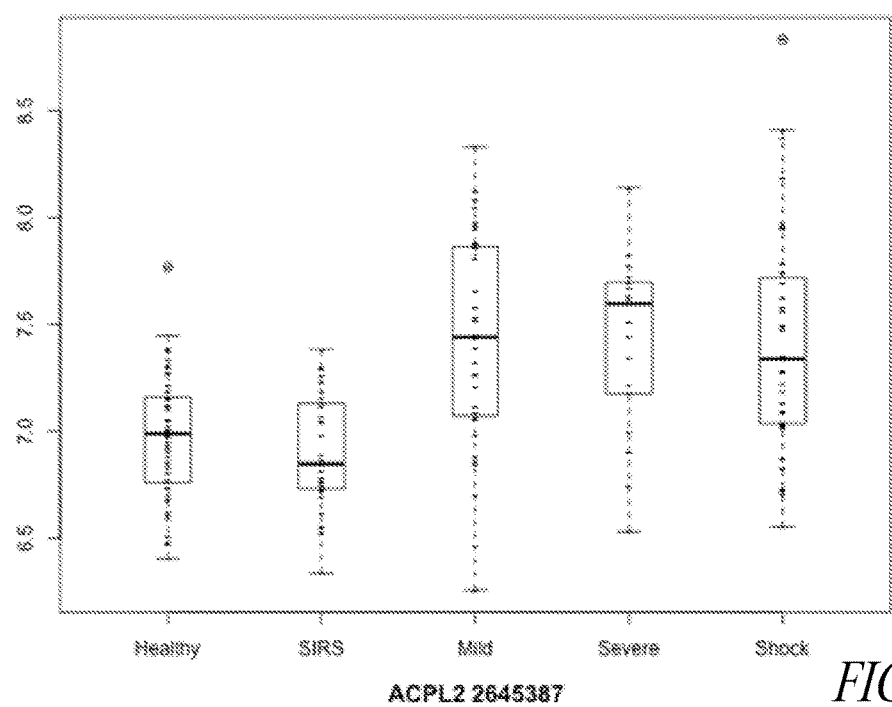

FIG. 195 shows a box and whiskers plot of ACTA2 gene expression for healthy subjects and subjects with SIRS, mild sepsis, severe sepsis.

Figure 196:
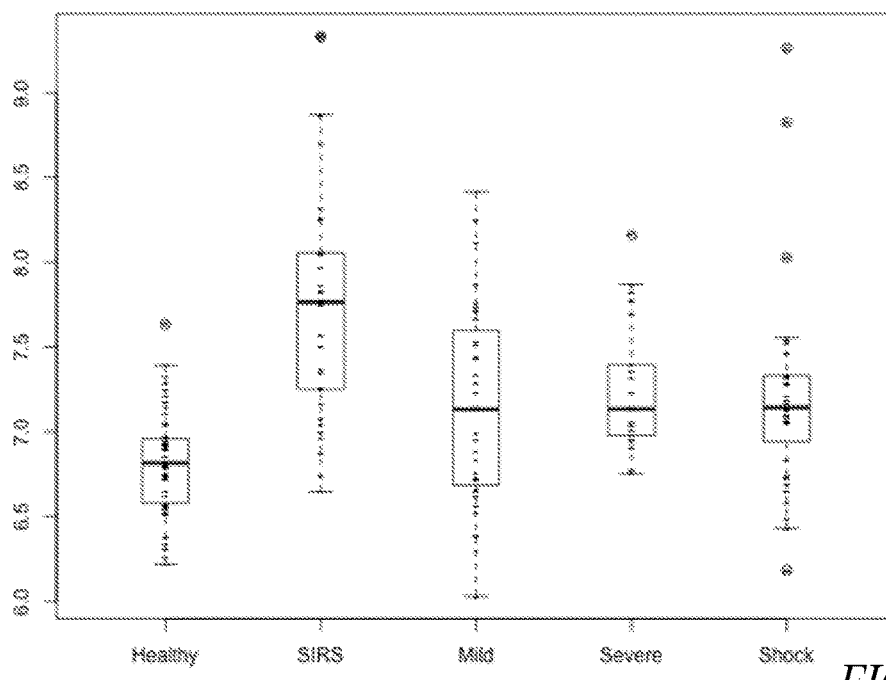

FIG. 196 shows a box and whiskers plot of ACPL2 gene expression for healthy subjects and subjects with SIRS, mild sepsis, severe sepsis.

Figure 197:
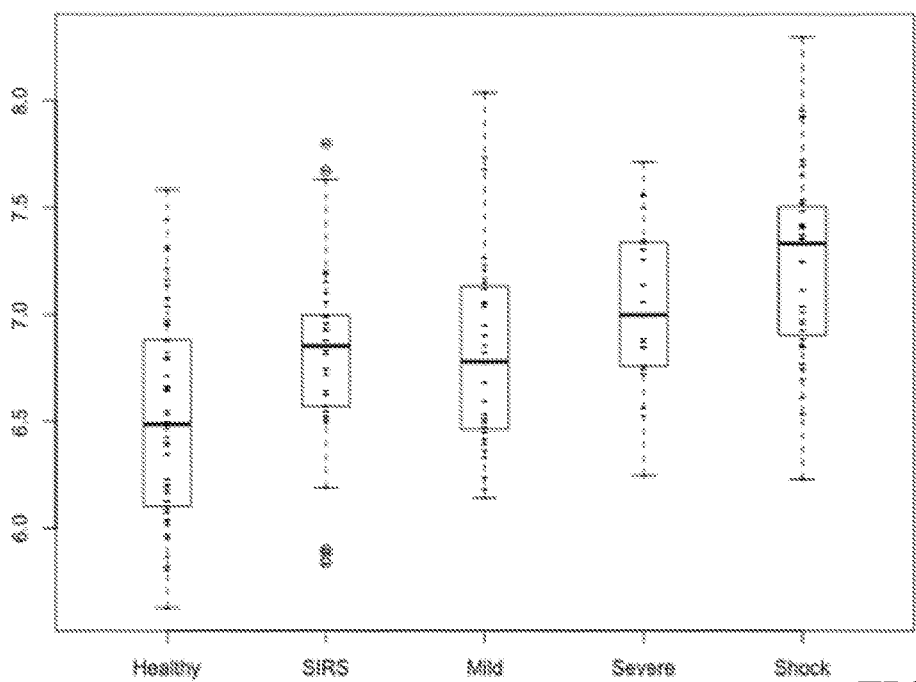

FIG. 197 shows a box and whiskers plot of LRRFIP1 gene expression for healthy subjects and subjects with SIRS, mild sepsis, severe sepsis.

Figure 198:
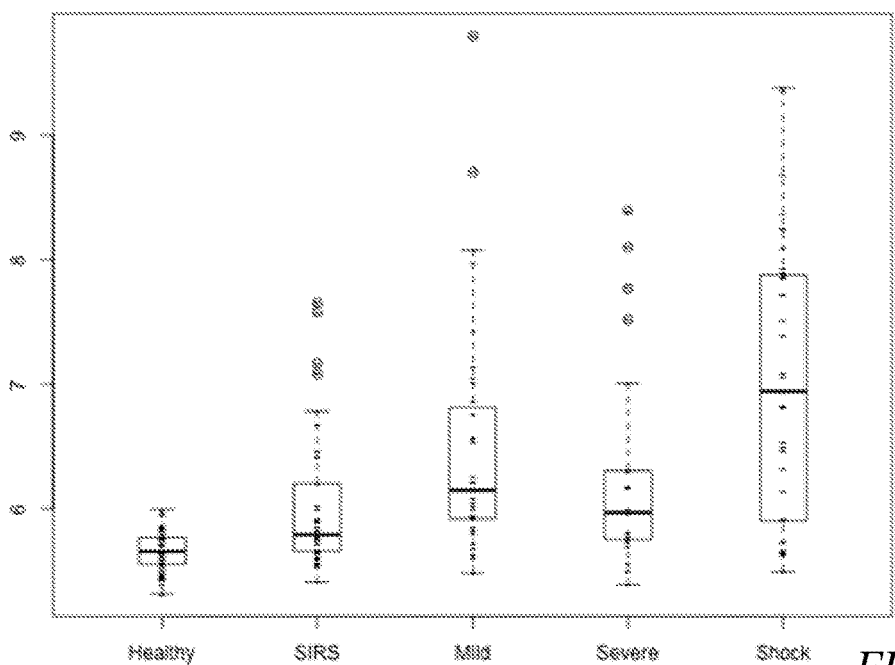

FIG. 198 shows a box and whiskers plot of KCNMA1 gene expression for healthy subjects and subjects with SIRS, mild sepsis, severe sepsis.

Figure 199:
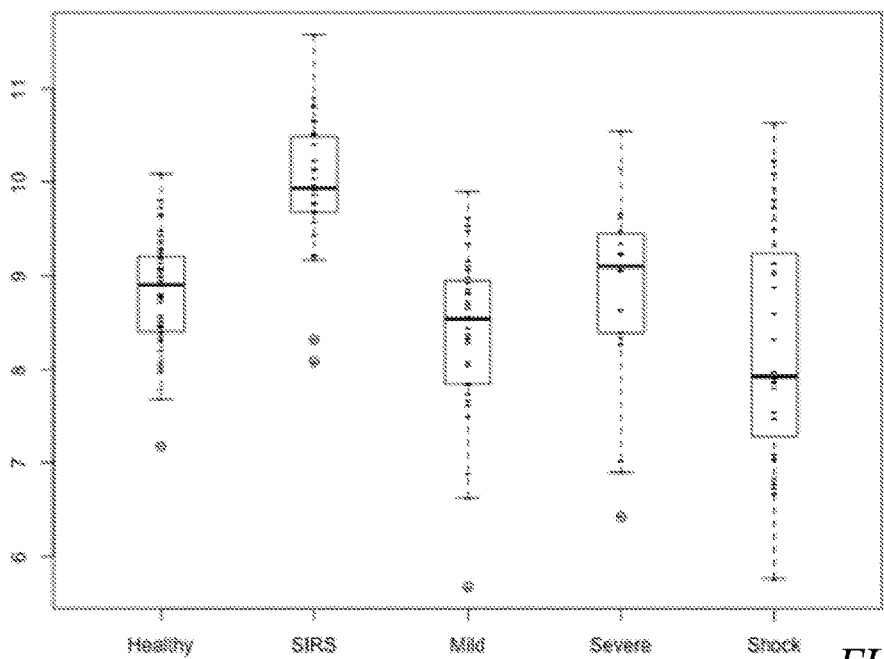

FIG. 199 shows a box and whiskers plot of OCR1 gene expression for healthy subjects and subjects with SIRS, mild sepsis, severe sepsis.

Figure 200:
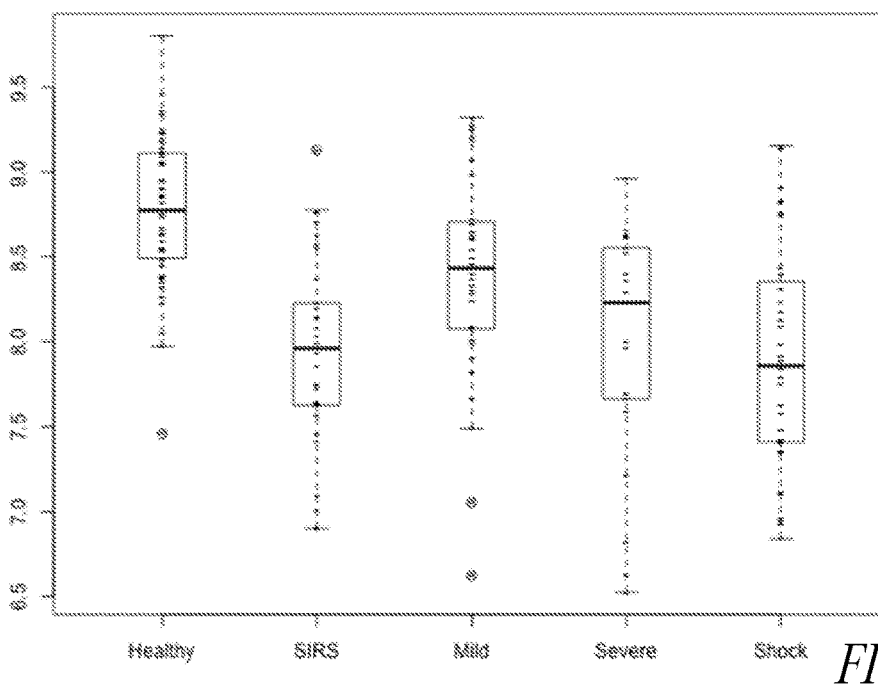

FIG. 200 shows a box and whiskers plot of ITGA4//CERKL gene expression for healthy subjects and subjects with SIRS, mild sepsis, severe sepsis.

Figure 201:
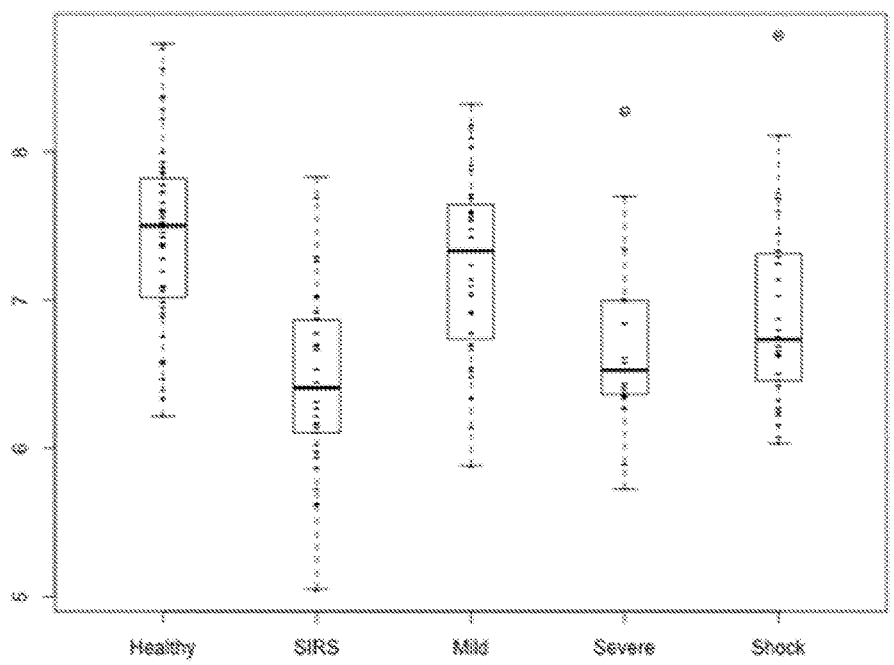

FIG. 201 shows a box and whiskers plot of EIF1AX//SCARNA9L//EIF1AP1 gene expression for healthy subjects and subjects with SIRS, mild sepsis, severe sepsis.

Figure 202:
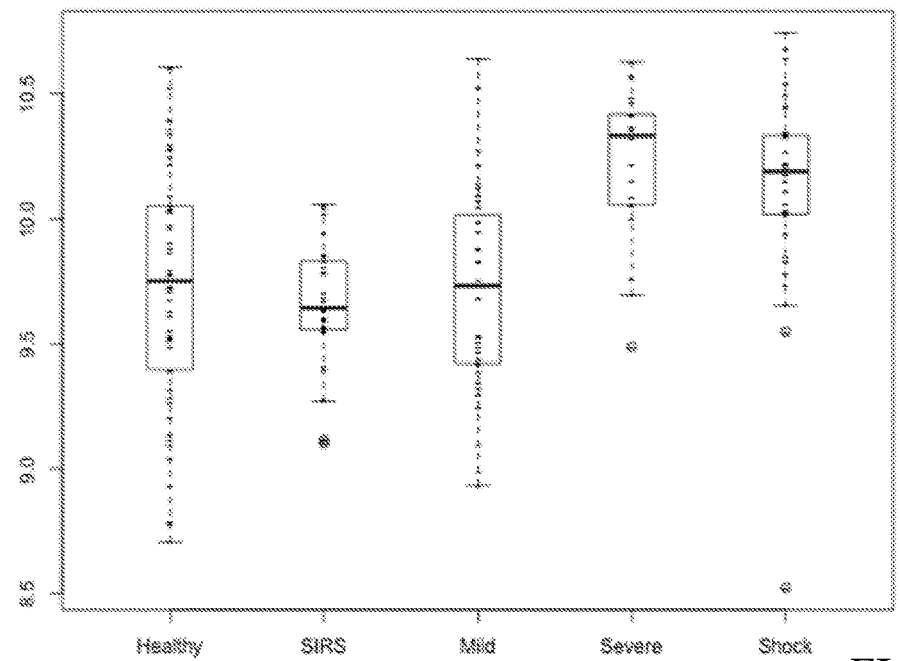

FIG. 202 shows a box and whiskers plot of SFRS9 gene expression for healthy subjects and subjects with SIRS, mild sepsis, severe sepsis.

Figure 203:
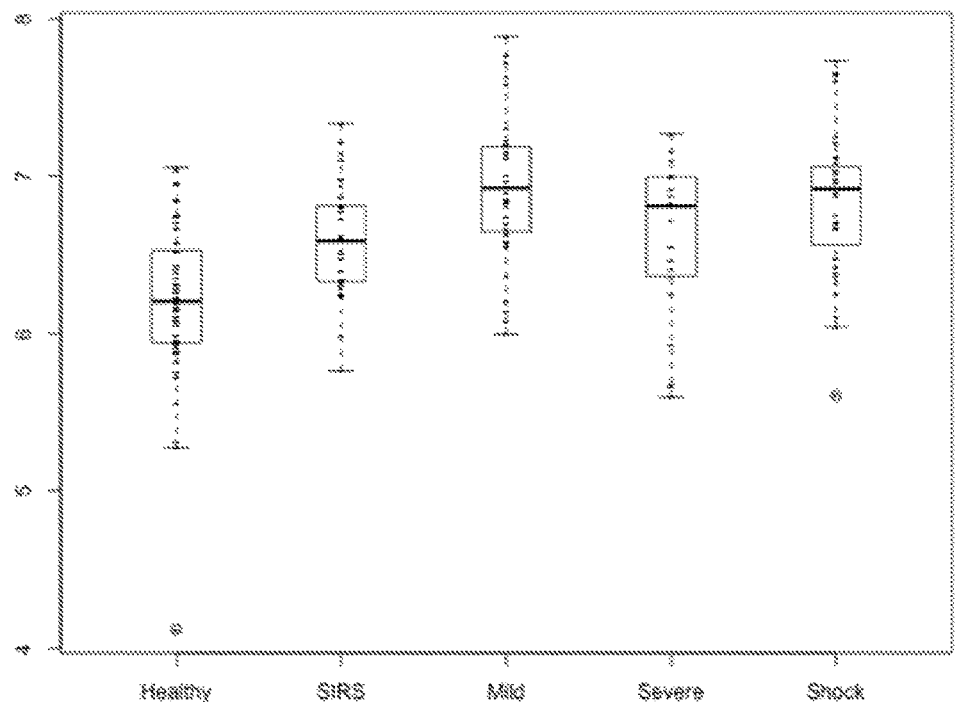

FIG. 203 shows a box and whiskers plot of DPH3 gene expression for healthy subjects and subjects with SIRS, mild sepsis, severe sepsis.

Figure 204:
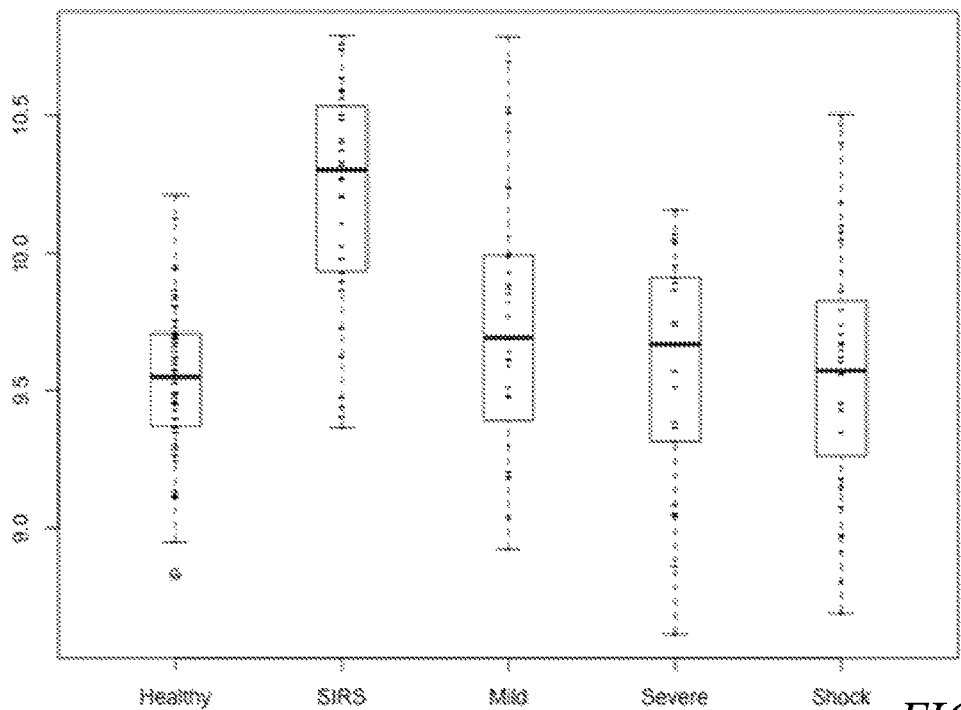

FIG. 204 shows a box and whiskers plot of ERGIC1 gene expression for healthy subjects and subjects with SIRS, mild sepsis, severe sepsis.

Figure 205:
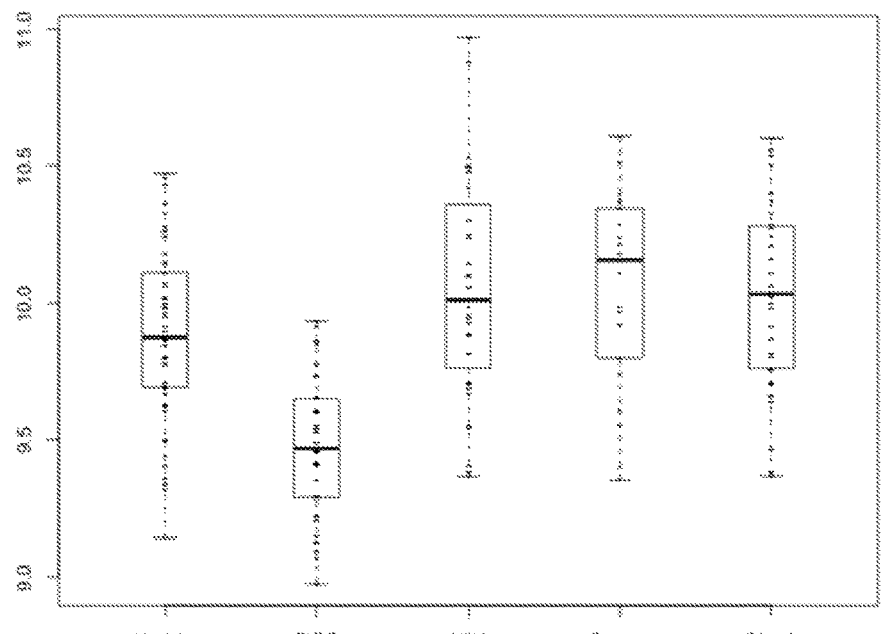

FIG. 205 shows a box and whiskers plot of CD300A gene expression for healthy subjects and subjects with SIRS, mild sepsis, severe sepsis.

Figure 206:
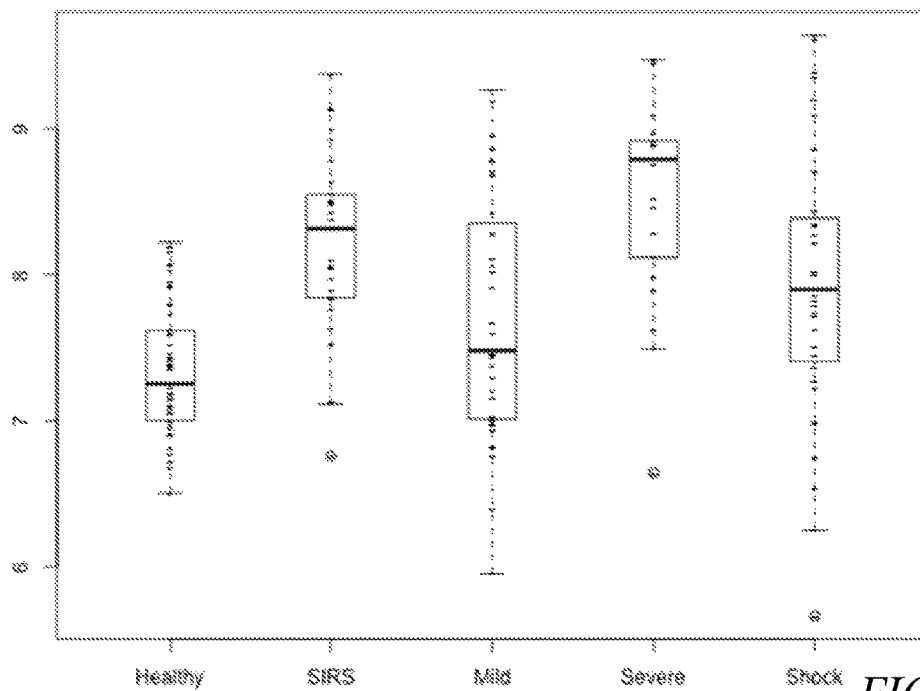

FIG. 206 shows a box and whiskers plot of NF-E4 gene expression for healthy subjects and subjects with SIRS, mild sepsis, severe sepsis.

Figure 207:
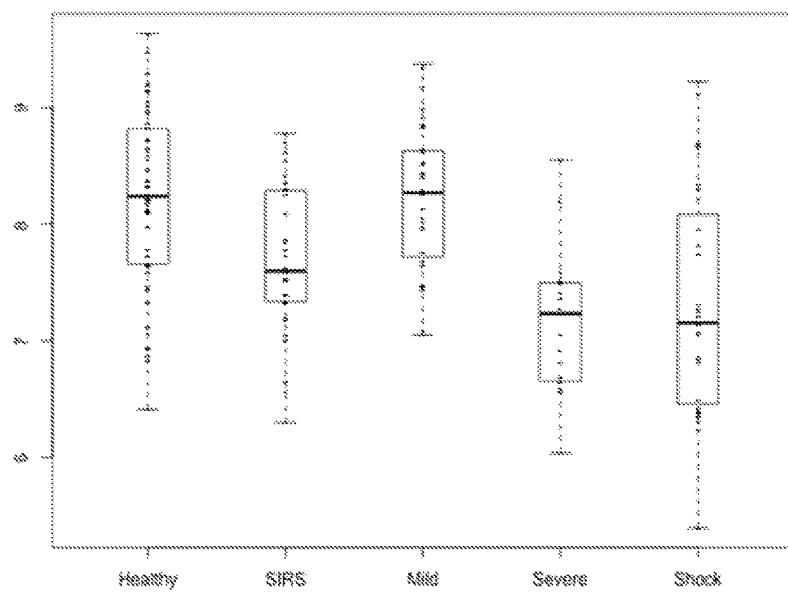

FIG. 207 shows a box and whiskers plot of MINPP1 gene expression for healthy subjects and subjects with SIRS, mild sepsis, severe sepsis.

Figure 208:
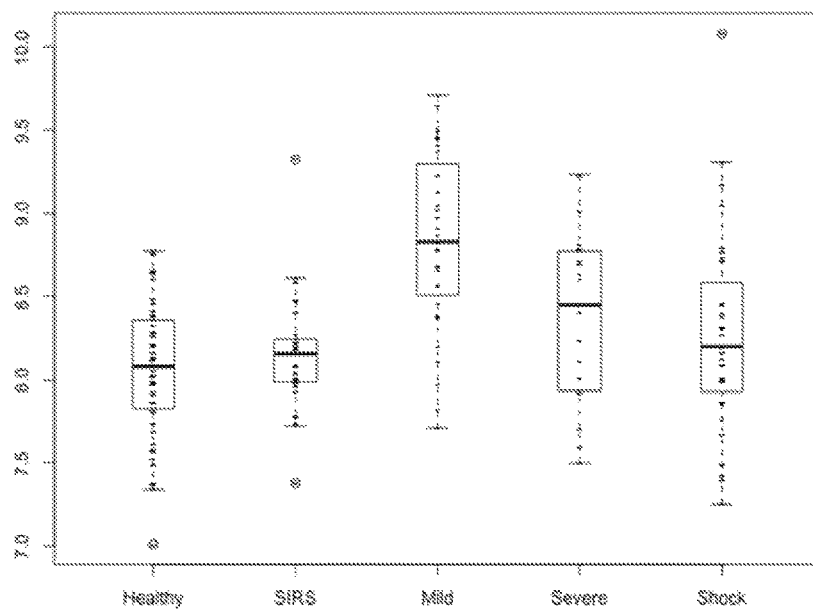

FIG. 208 shows a box and whiskers plot of TRIM21 gene expression for healthy subjects and subjects with SIRS, mild sepsis, severe sepsis.

Figure 209:
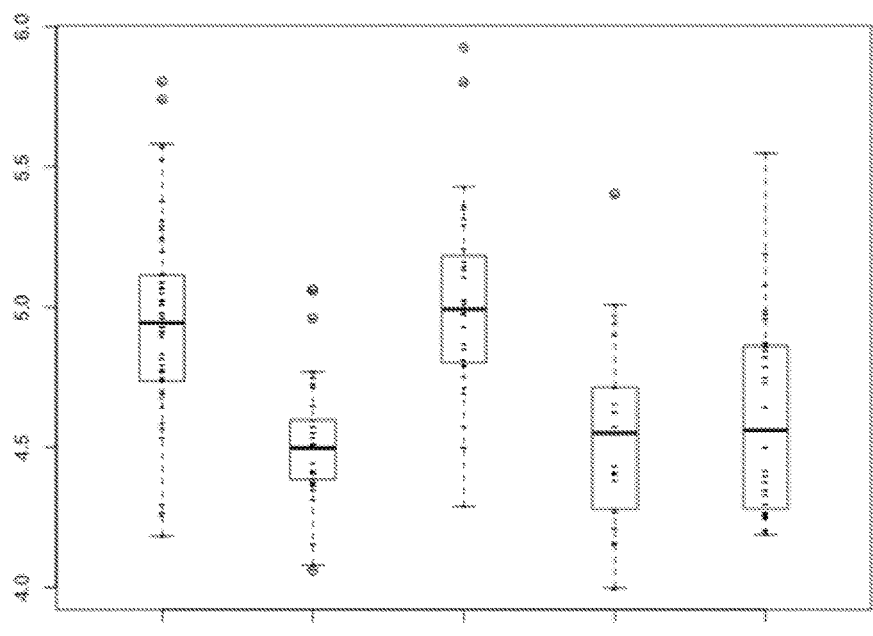

FIG. 209 shows a box and whiskers plot of ZNF28 gene expression for healthy subjects and subjects with SIRS, mild sepsis, severe sepsis.

Figure 210:
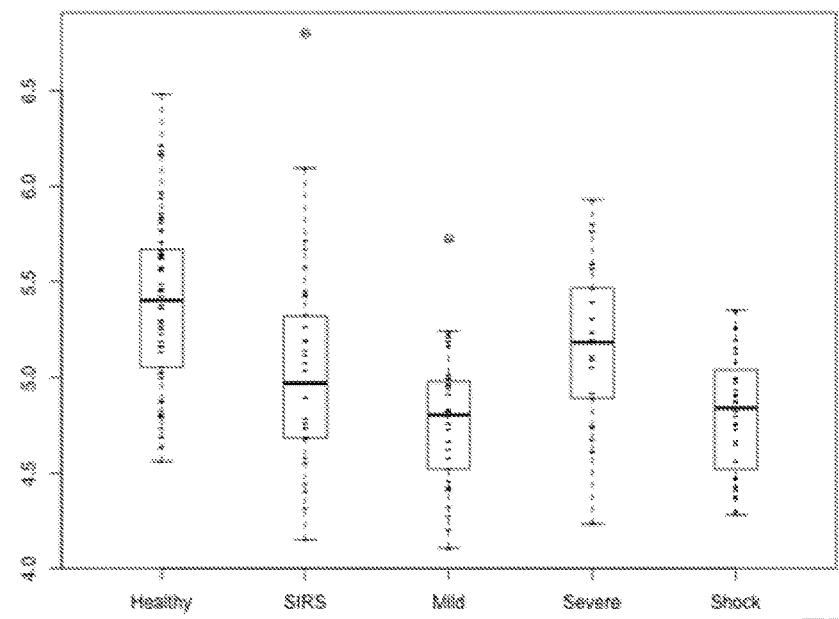

FIG. 210 shows a box and whiskers plot of NPCDR1 gene expression for healthy subjects and subjects with SIRS, mild sepsis, severe sepsis.

Figure 211:
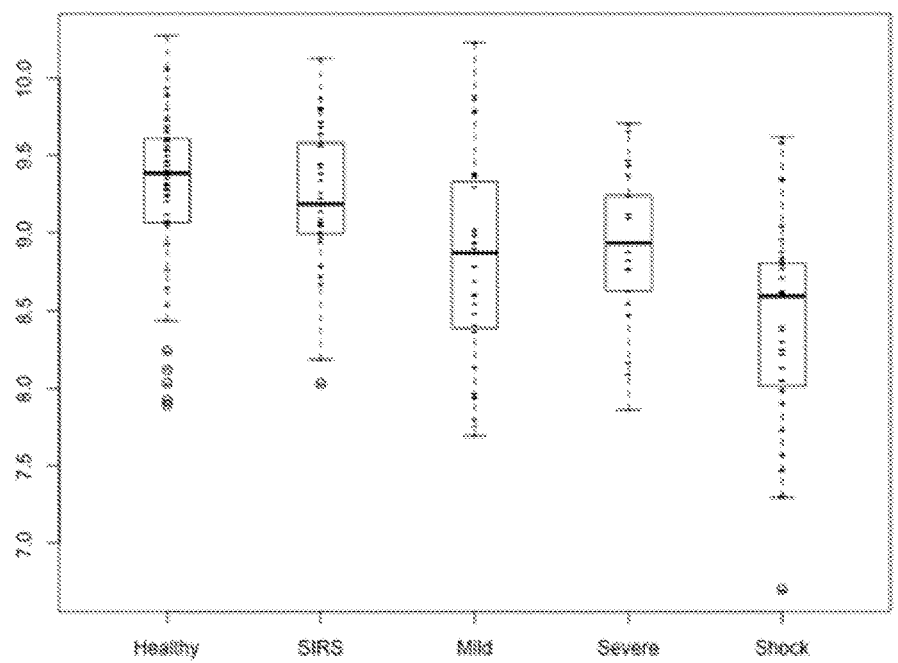

FIG. 211 shows a box and whiskers plot of NA gene expression for healthy subjects and subjects with SIRS, mild sepsis, severe sepsis.

Figure 212:
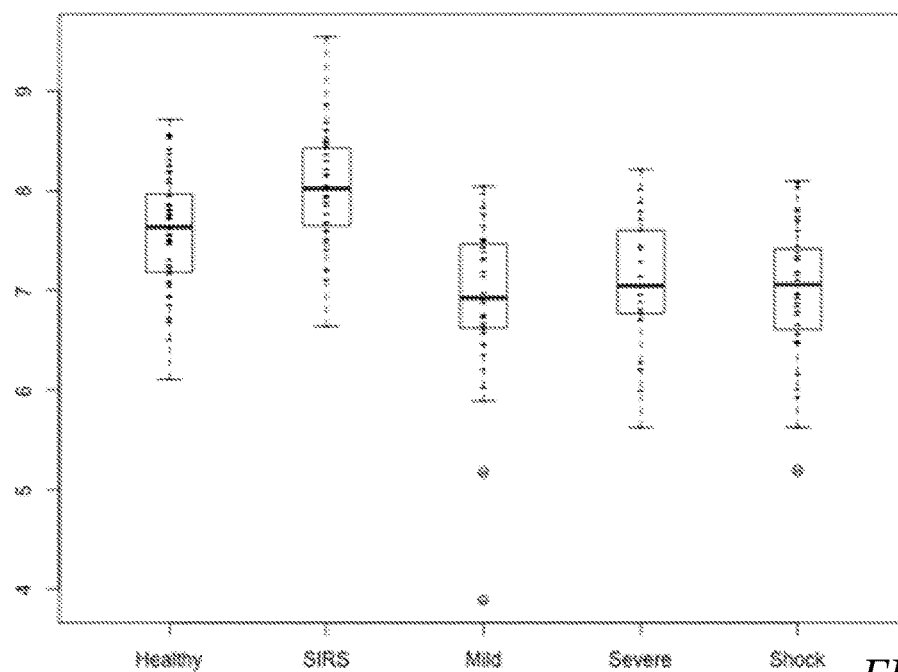

FIG. 212 shows a box and whiskers plot of NA gene expression for healthy subjects and subjects with SIRS, mild sepsis, severe sepsis.

Figure 213:
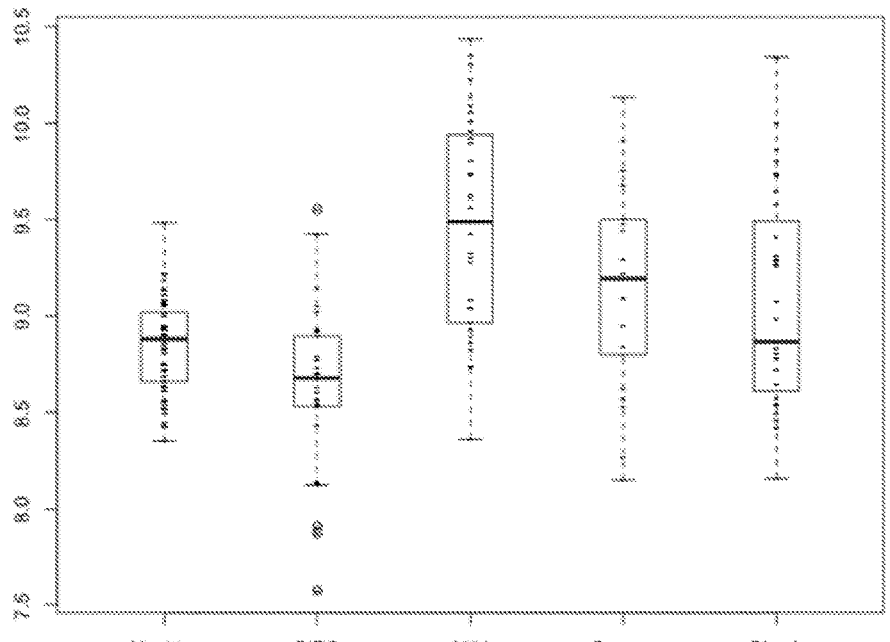

FIG. 213 shows a box and whiskers plot of ICAM1 gene expression for healthy subjects and subjects with SIRS, mild sepsis, severe sepsis.

Figure 214:
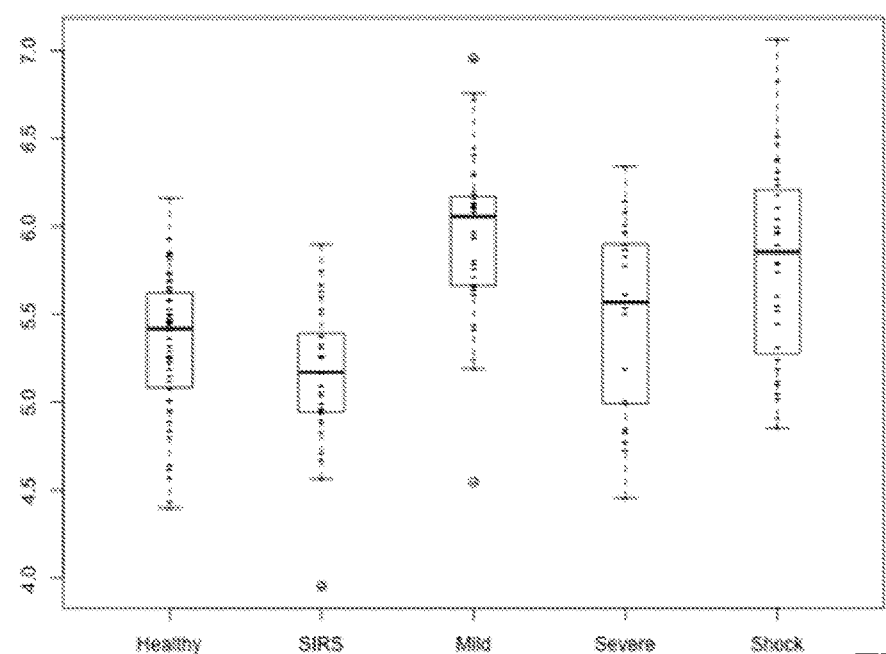

FIG. 214 shows a box and whiskers plot of TAF13 gene expression for healthy subjects and subjects with SIRS, mild sepsis, severe sepsis.

Figure 215:
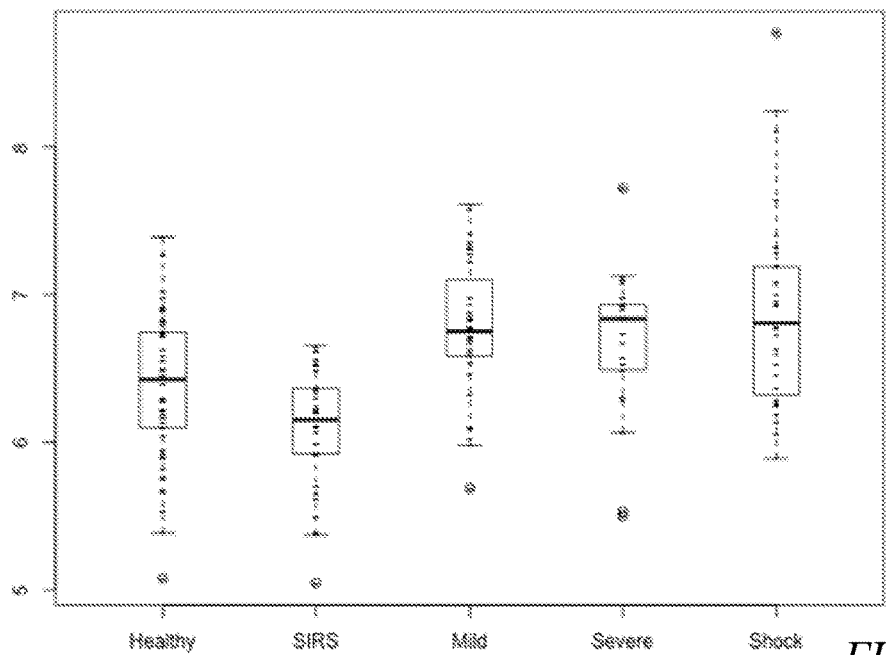

FIG. 215 shows a box and whiskers plot of P4HA1//RPL17 gene expression for healthy subjects and subjects with SIRS, mild sepsis, severe sepsis.

Figure 216:
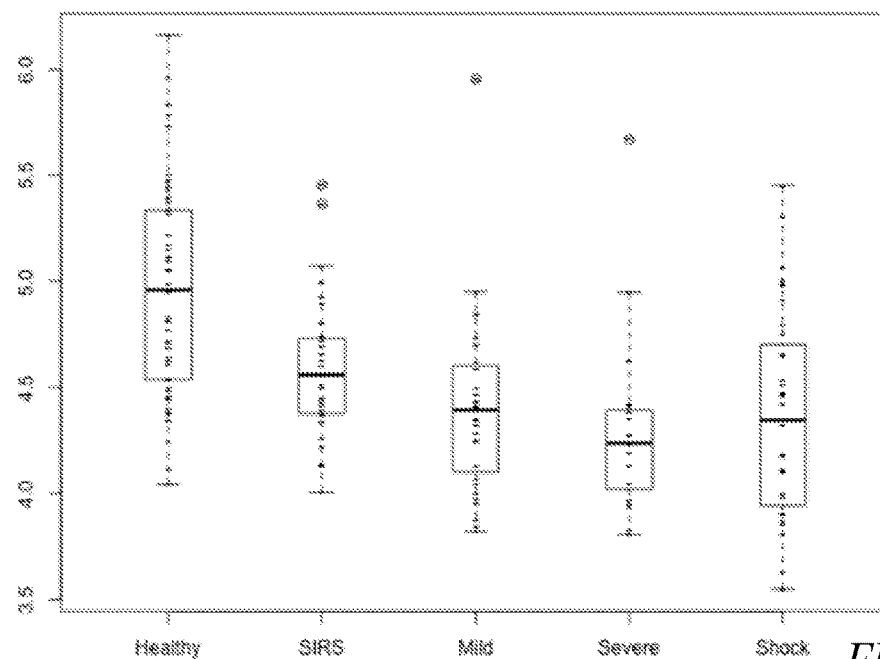

FIG. 216 shows a box and whiskers plot of C15orf54 gene expression for healthy subjects and subjects with SIRS, mild sepsis, severe sepsis.

Figure 217:
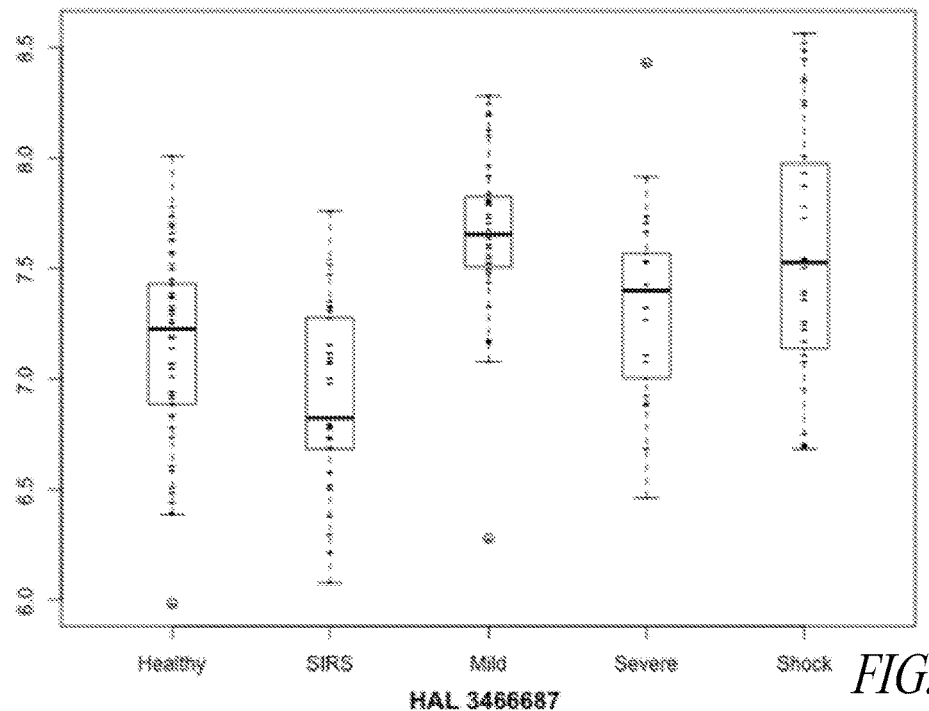

FIG. 217 shows a box and whiskers plot of KLHL5 gene expression for healthy subjects and subjects with SIRS, mild sepsis, severe sepsis.

Figure 218:
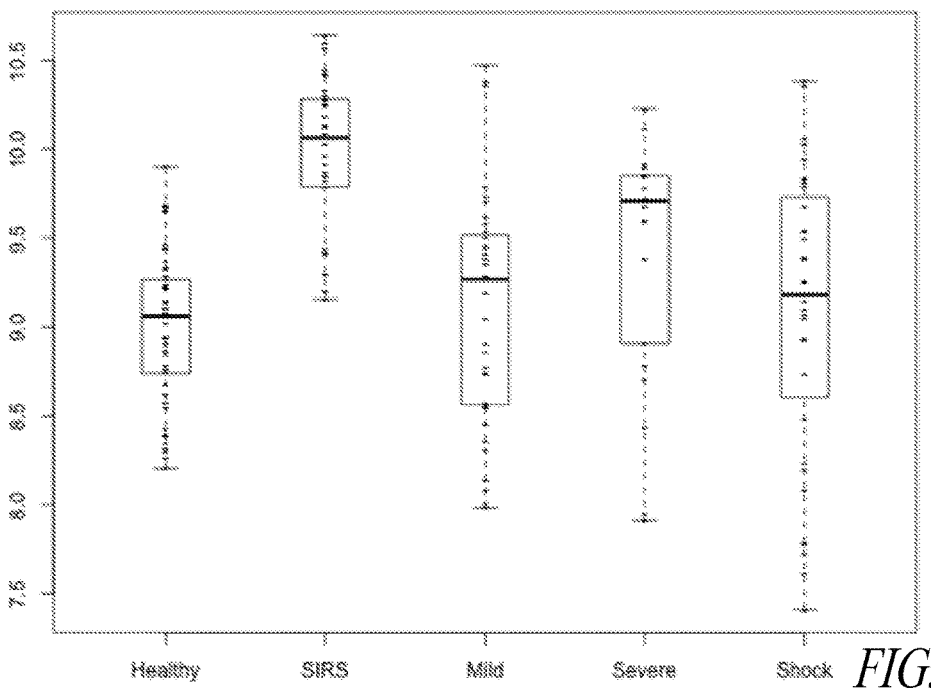

FIG. 218 shows a box and whiskers plot of HAL gene expression for healthy subjects and subjects with SIRS, mild sepsis, severe sepsis.

Figure 219:
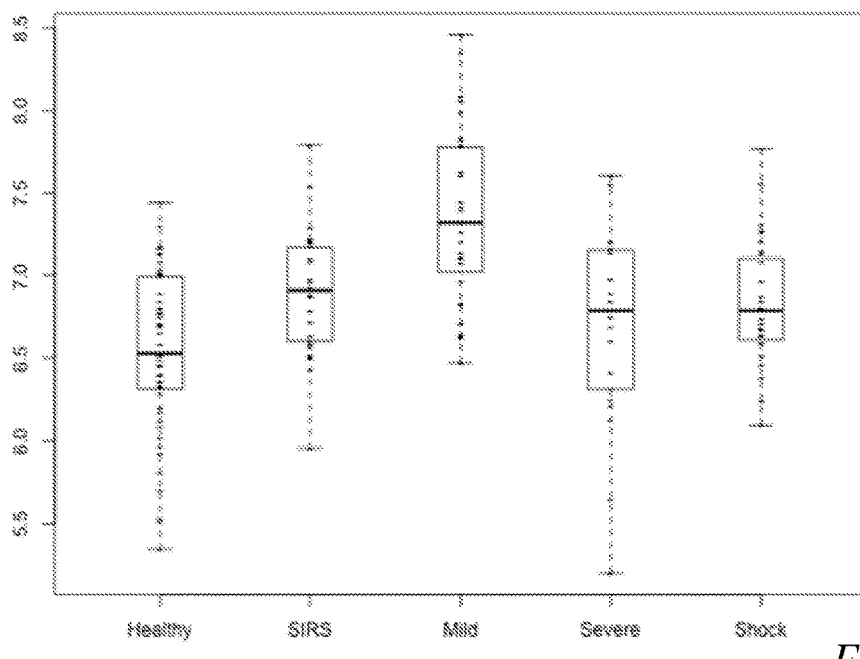

FIG. 219 shows a box and whiskers plot of DLEU2//DLEU2L gene expression for healthy subjects and subjects with SIRS, mild sepsis, severe sepsis.

Figure 220:
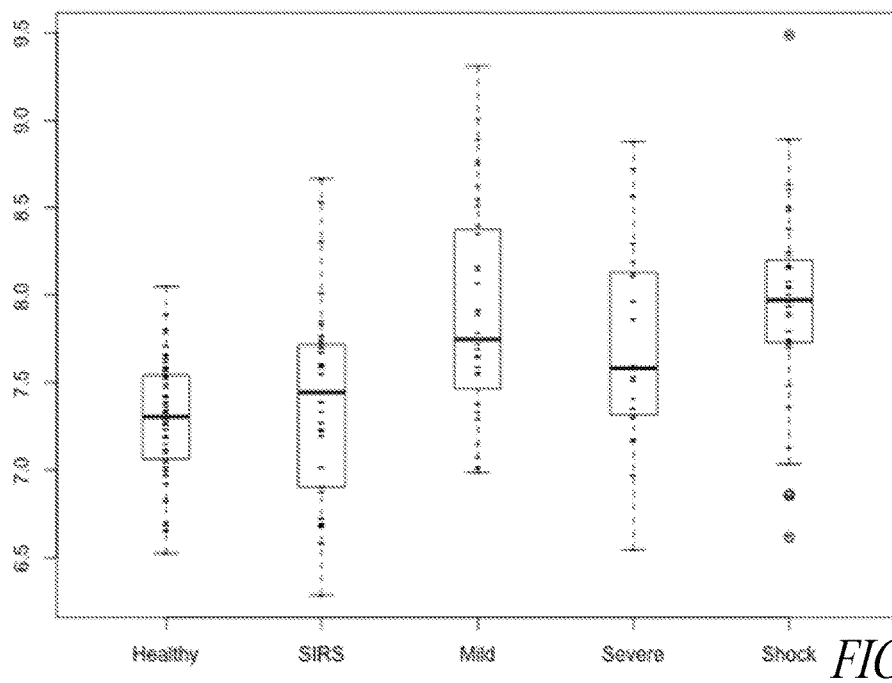

FIG. 220 shows a box and whiskers plot of ANKRD28 gene expression for healthy subjects and subjects with SIRS, mild sepsis, severe sepsis.

Figure 221:
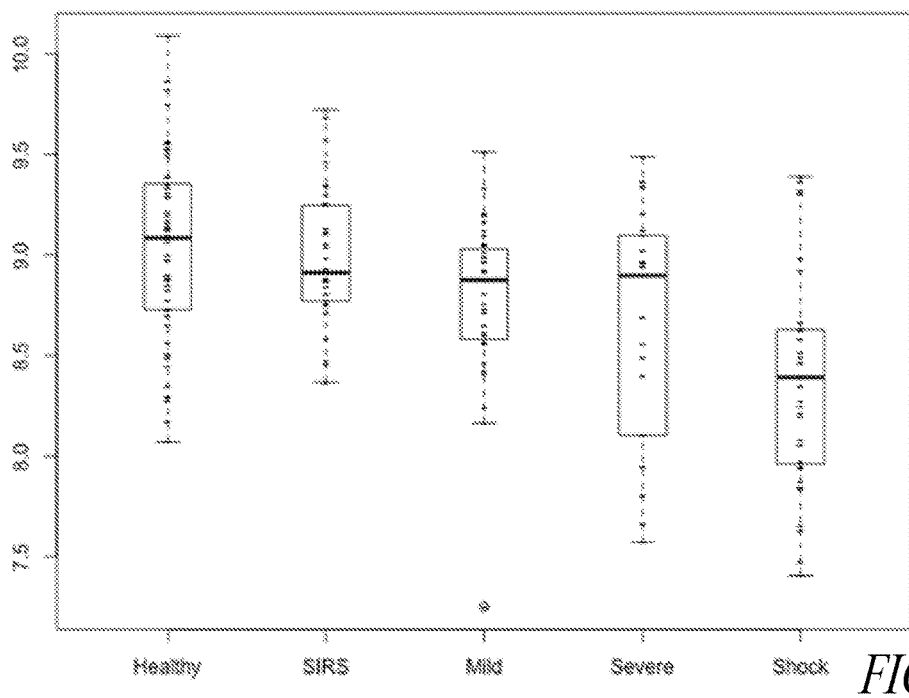

FIG. 221 shows a box and whiskers plot of LY6G5B//CSNK2B gene expression for healthy subjects and subjects with SIRS, mild sepsis, severe sepsis.

Figure 222:
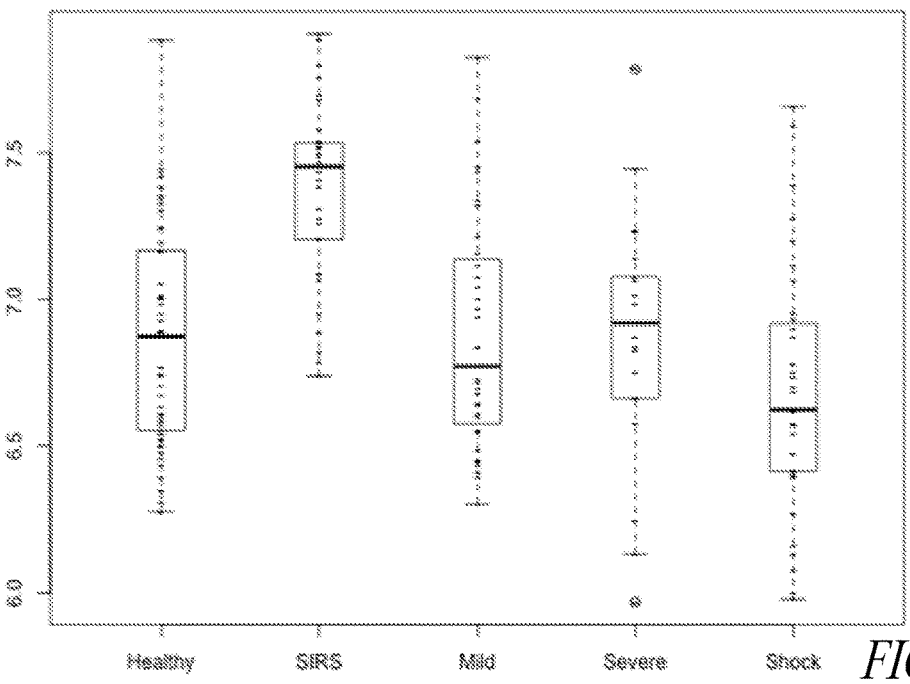

FIG. 222 shows a box and whiskers plot of KIAA1257//ACAD9//LOC100132731 gene expression for healthy subjects and subjects with SIRS, mild sepsis, severe sepsis.

Figure 223:
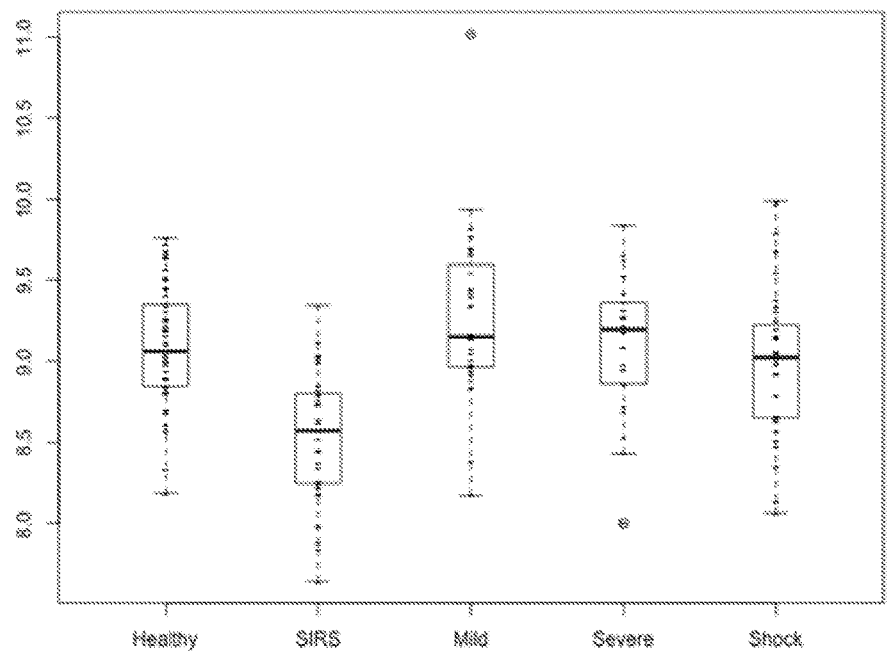

FIG. 223 shows a box and whiskers plot of MGST3 gene expression for healthy subjects and subjects with SIRS, mild sepsis, severe sepsis.

Figure 224:
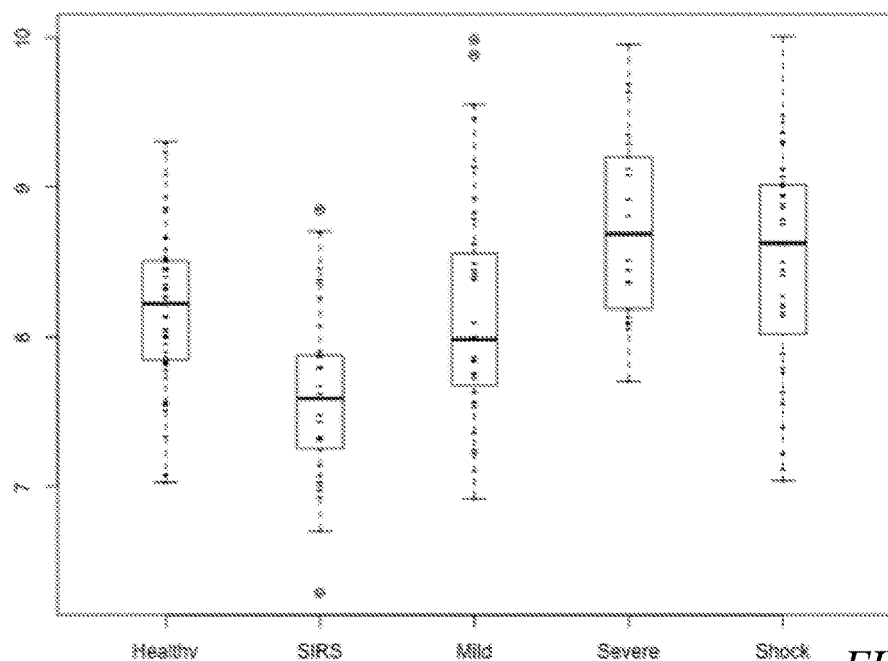

FIG. 224 shows a box and whiskers plot of KIAA0746 gene expression for healthy subjects and subjects with SIRS, mild sepsis, severe sepsis.

Figure 225:
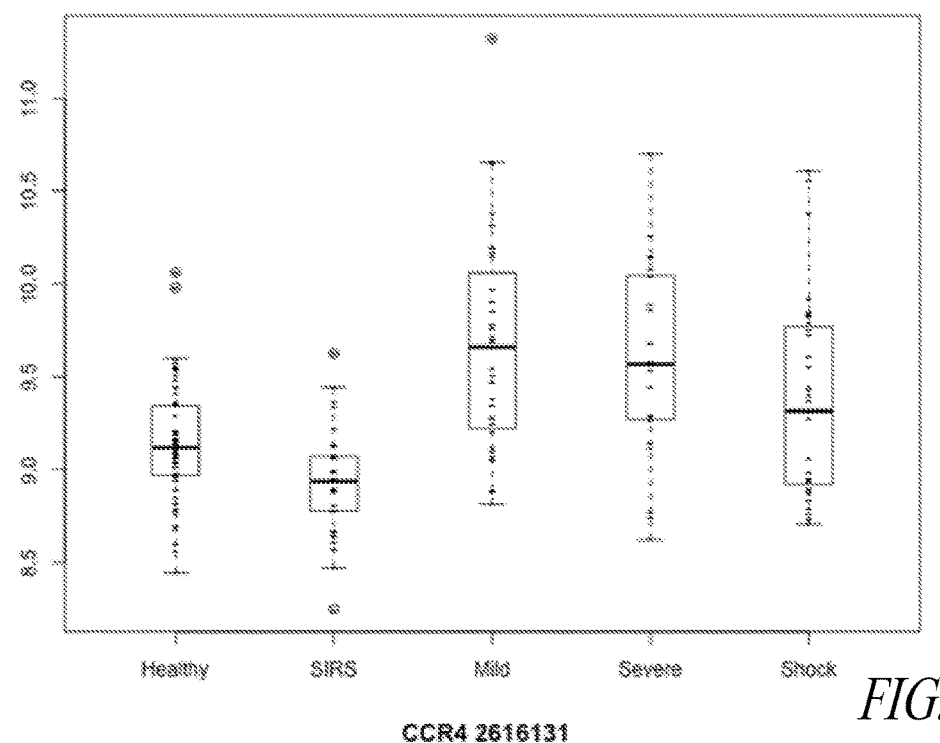

FIG. 225 shows a box and whiskers plot of HSPB1//HSPBL2 gene expression for healthy subjects and subjects with SIRS, mild sepsis, severe sepsis.

Figure 226:
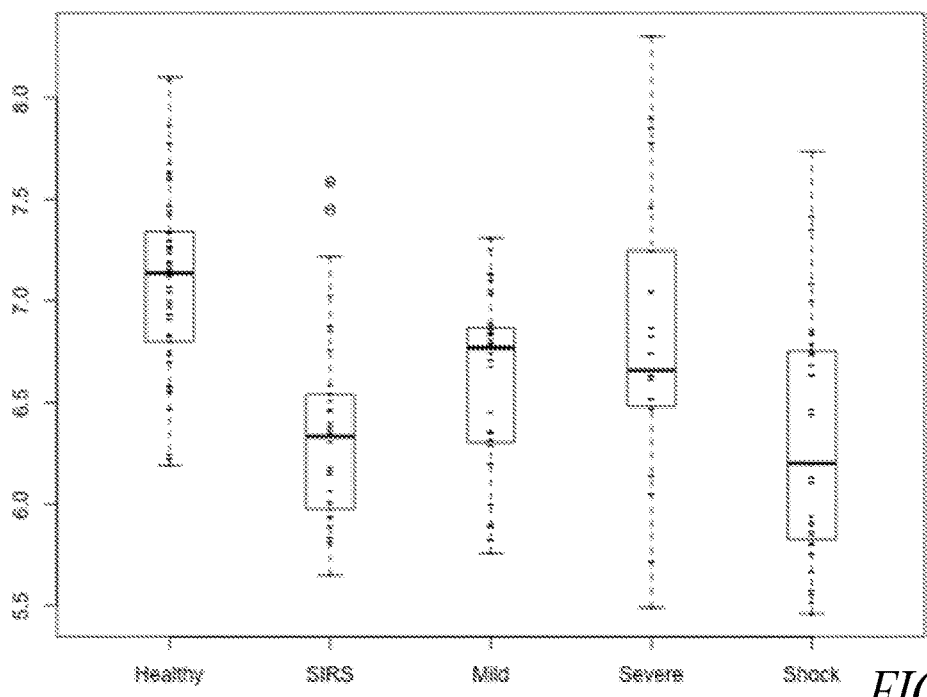

FIG. 226 shows a box and whiskers plot of CCR4 gene expression for healthy subjects and subjects with SIRS, mild sepsis, severe sepsis.

Figure 227:
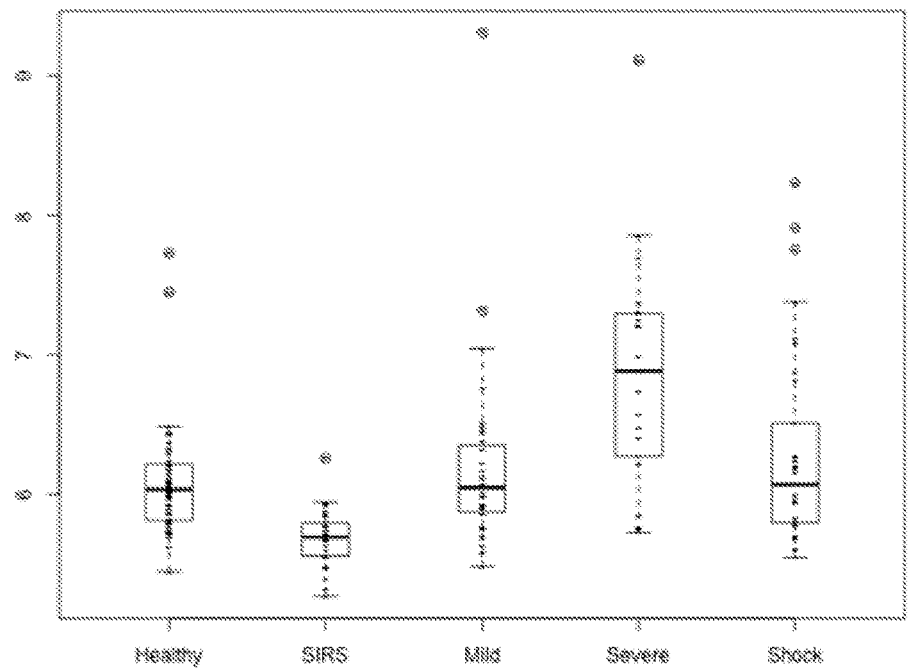

FIG. 227 shows a box and whiskers plot of TYMS gene expression for healthy subjects and subjects with SIRS, mild sepsis, severe sepsis.

Figure 228:
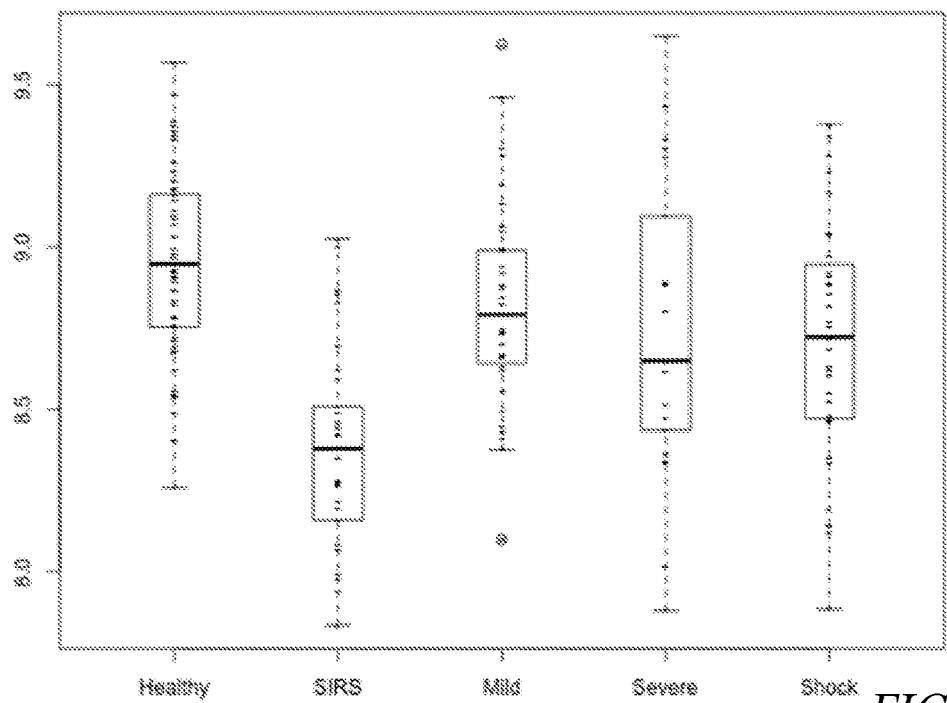

FIG. 228 shows a box and whiskers plot of RRP12//LOC644215 gene expression for healthy subjects and subjects with SIRS, mild sepsis, severe sepsis.

Figure 229:
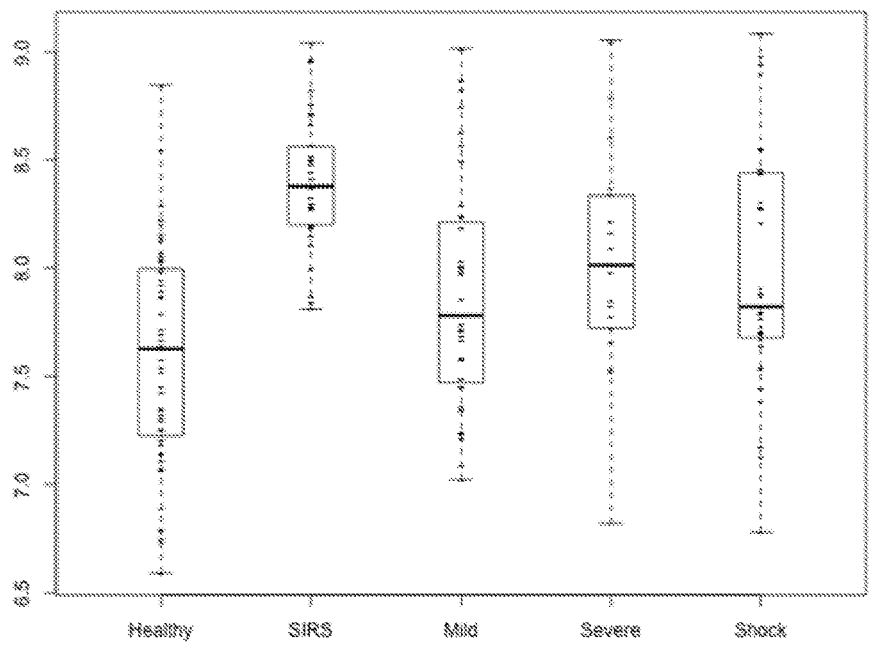

FIG. 229 shows a box and whiskers plot of CCDC125 gene expression for healthy subjects and subjects with SIRS, mild sepsis, severe sepsis.

Figure 230:
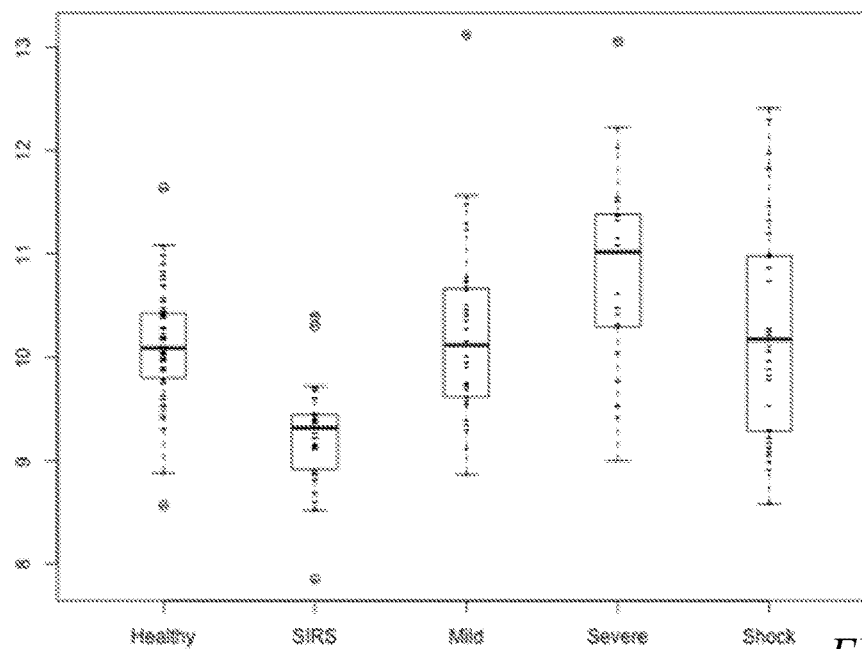

FIG. 230 shows a box and whiskers plot of HIST1H2BM gene expression for healthy subjects and subjects with SIRS, mild sepsis, severe sepsis.

Figure 231:
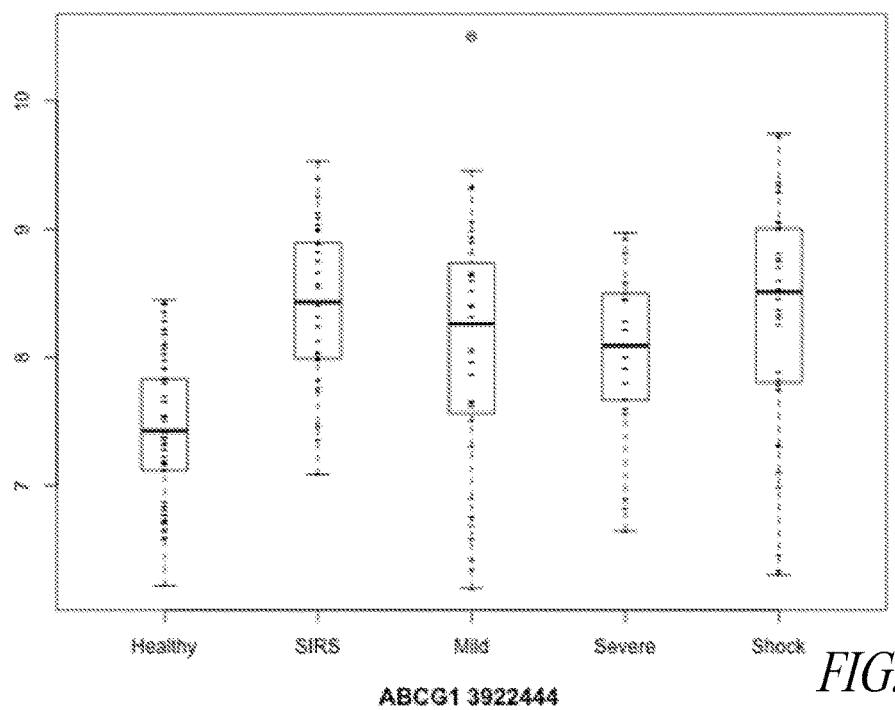

FIG. 231 shows a box and whiskers plot of PDK4 gene expression for healthy subjects and subjects with SIRS, mild sepsis, severe sepsis.

Figure 232:
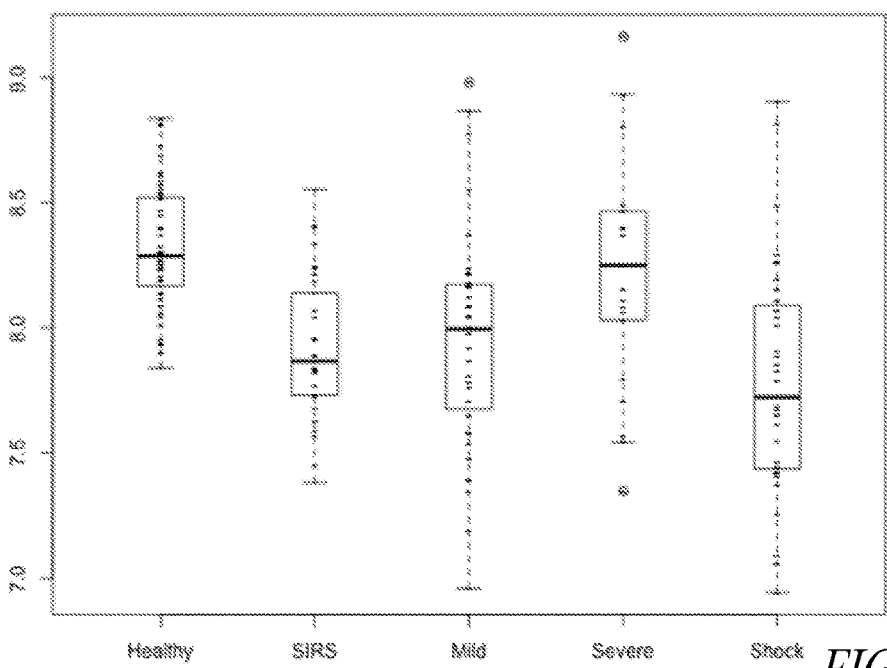

FIG. 232 shows a box and whiskers plot of ABCG1 gene expression for healthy subjects and subjects with SIRS, mild sepsis, severe sepsis.

Figure 233:
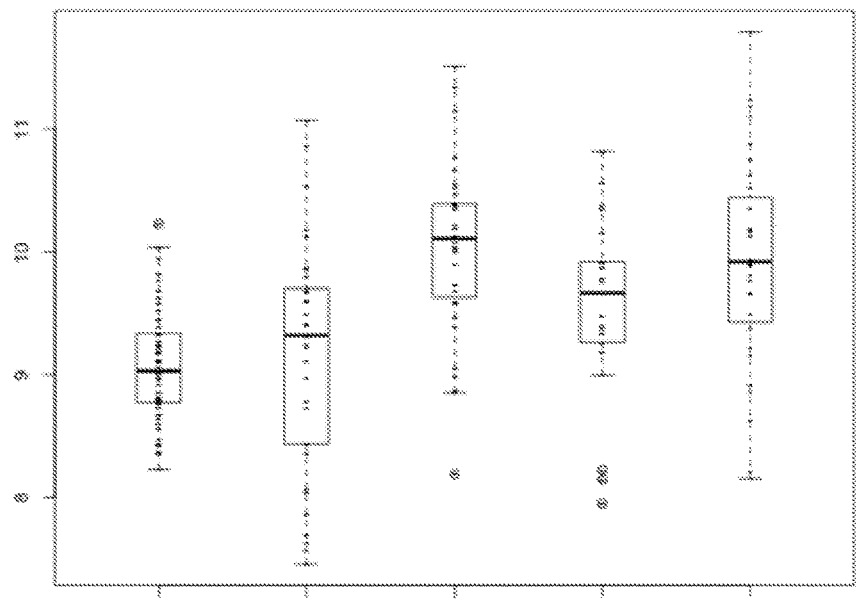

FIG. 233 shows a box and whiskers plot of IL1B gene expression for healthy subjects and subjects with SIRS, mild sepsis, severe sepsis.

Figure 234:
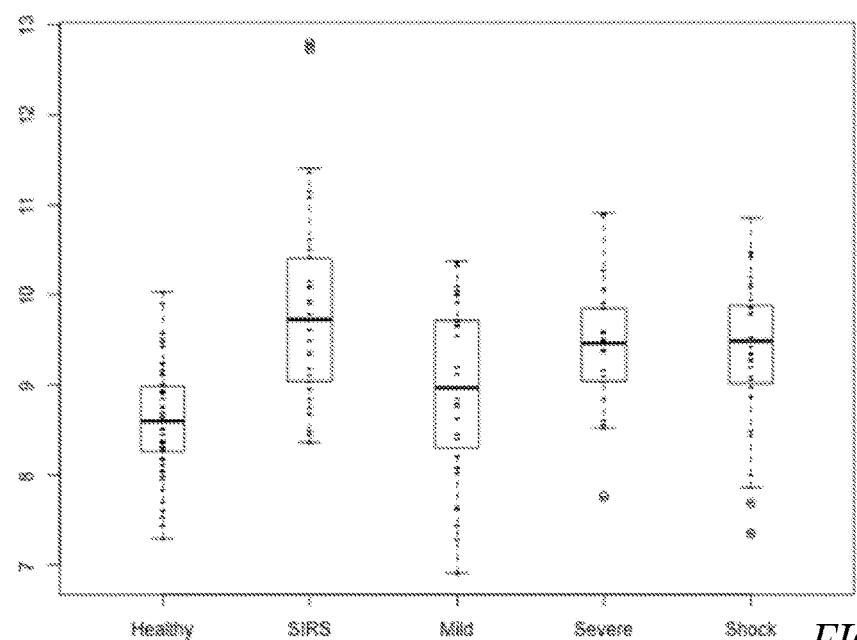

FIG. 234 shows a box and whiskers plot of THBS1 gene expression for healthy subjects and subjects with SIRS, mild sepsis, severe sepsis.

Figure 235:
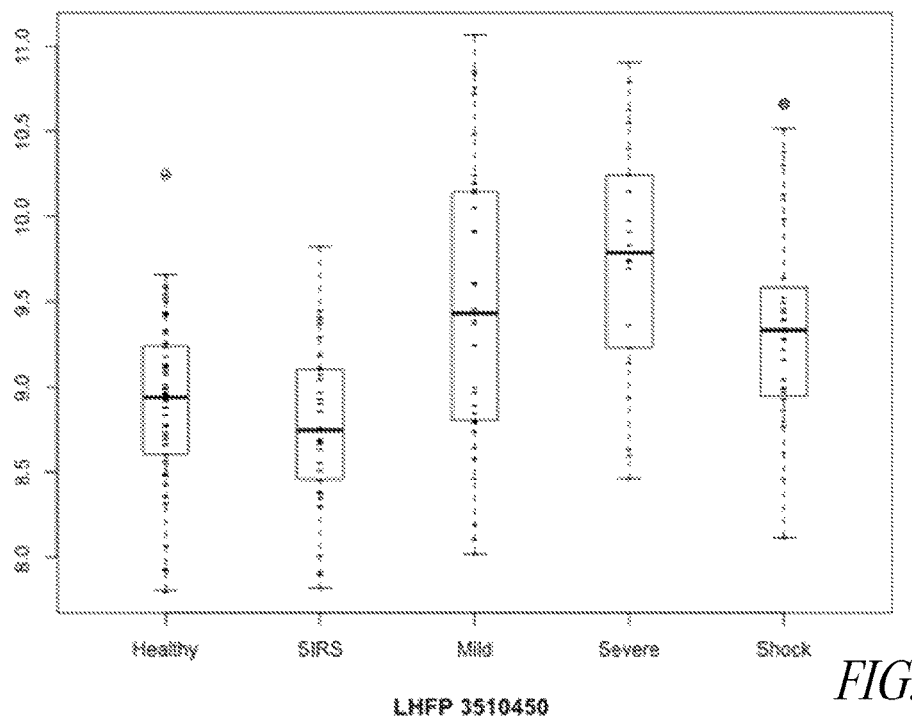

FIG. 235 shows a box and whiskers plot of ITGA2B gene expression for healthy subjects and subjects with SIRS, mild sepsis, severe sepsis.

Figure 236:
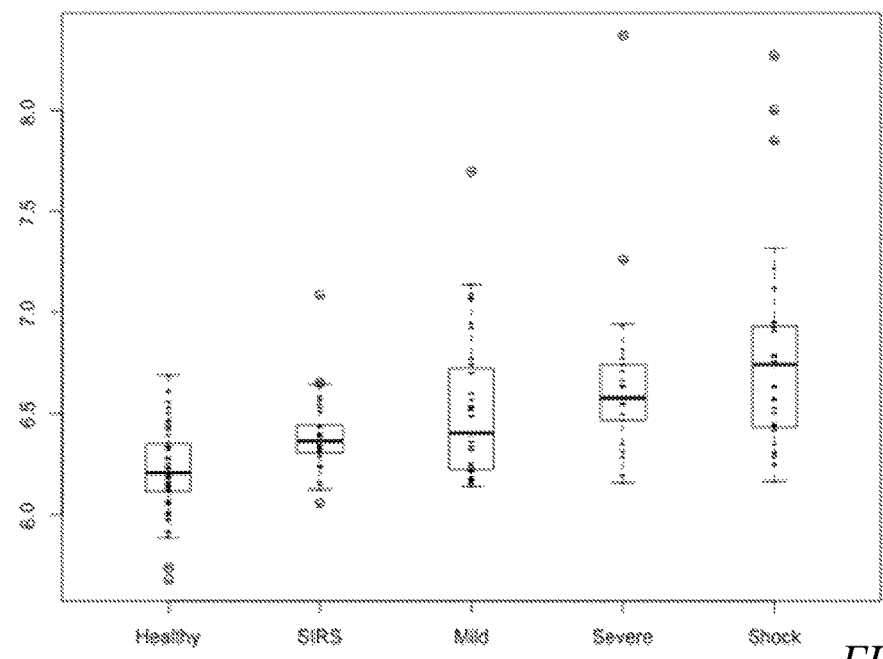

FIG. 236 shows a box and whiskers plot of LHFP gene expression for healthy subjects and subjects with SIRS, mild sepsis, severe sepsis.

Figure 237:
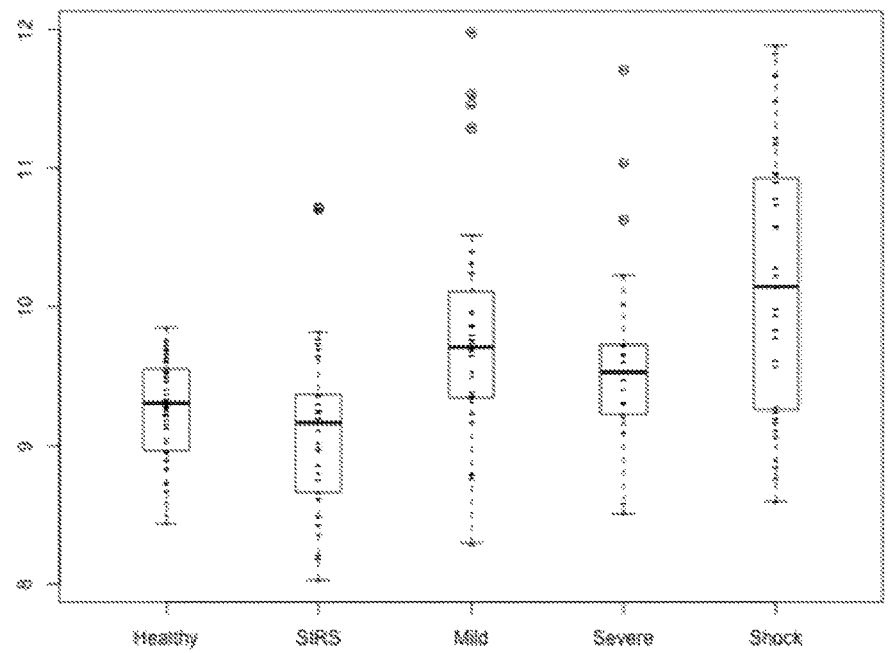

FIG. 237 shows a box and whiskers plot of LAIR1//LAIR2 gene expression for healthy subjects and subjects with SIRS, mild sepsis, severe sepsis.

Figure 238:
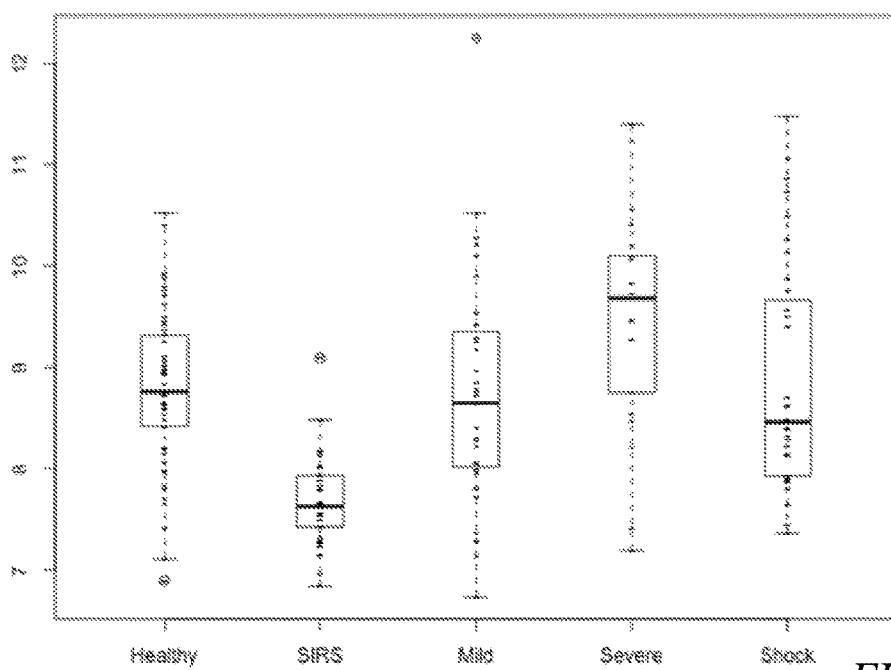

FIG. 238 shows a box and whiskers plot of HIST1H3B gene expression for healthy subjects and subjects with SIRS, mild sepsis, severe sepsis.

Figure 239:
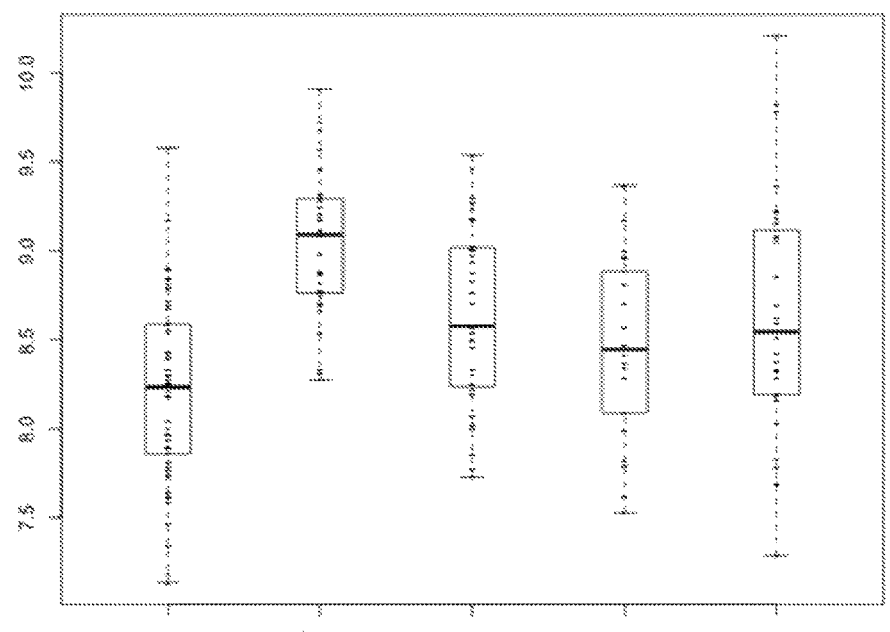

FIG. 239 shows a box and whiskers plot of ZRANB1 gene expression for healthy subjects and subjects with SIRS, mild sepsis, severe sepsis.

Figure 240:
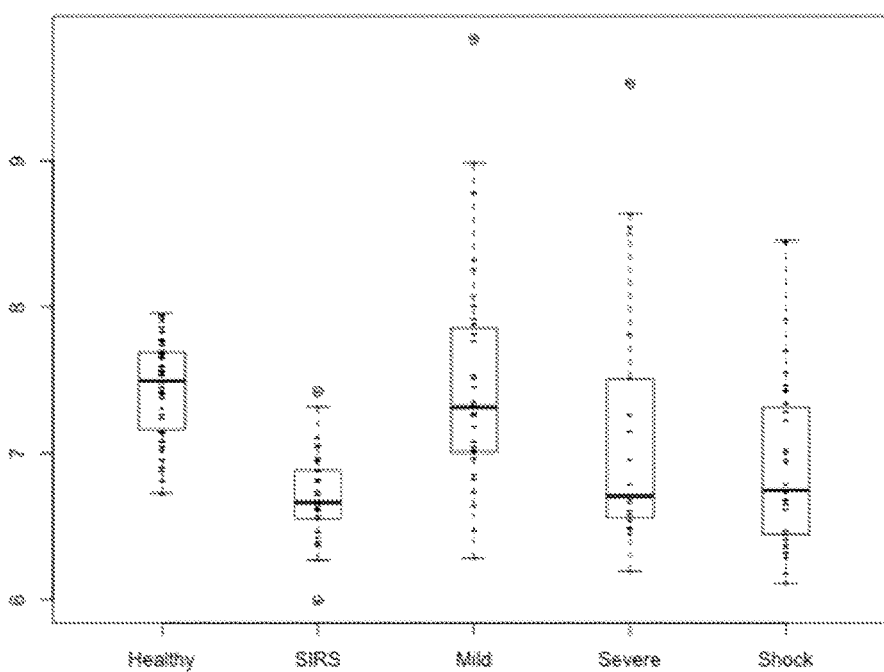

FIG. 240 shows a box and whiskers plot of TIMM10 gene expression for healthy subjects and subjects with SIRS, mild sepsis, severe sepsis.

Figure 241:
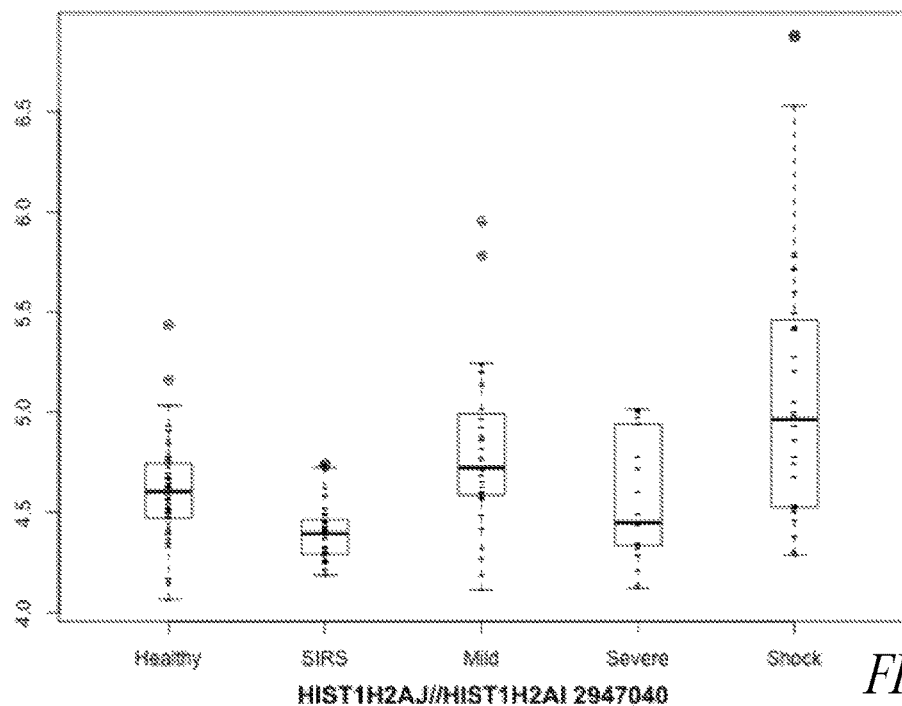

FIG. 241 shows a box and whiskers plot of FSD1L//GARNL1 gene expression for healthy subjects and subjects with SIRS, mild sepsis, severe sepsis.

Figure 242:
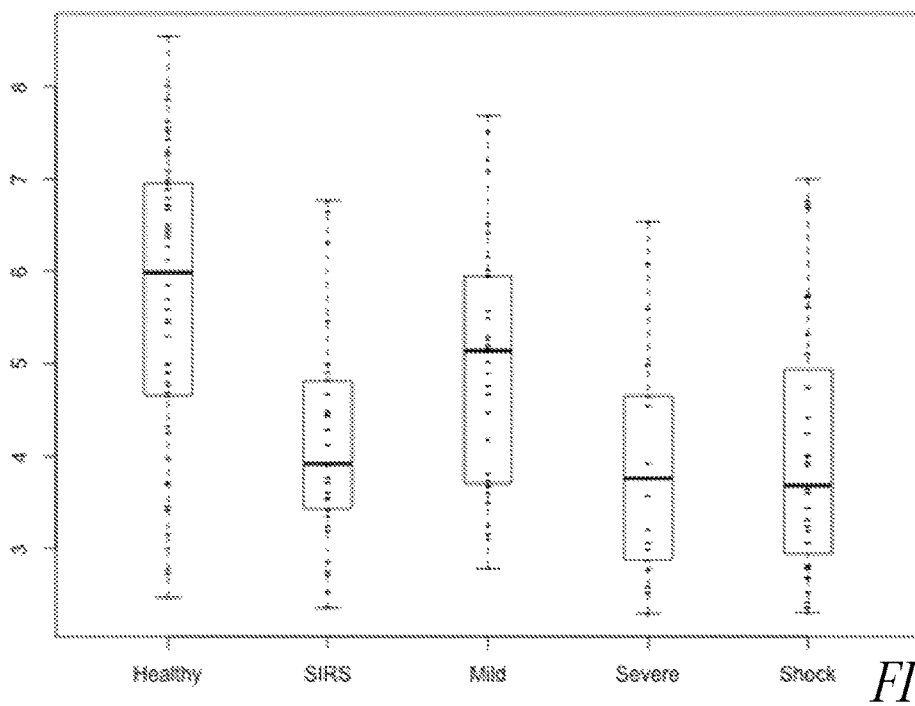

FIG. 242 shows a box and whiskers plot of HIST1H2AJ//HIST1H2AI gene expression for healthy subjects and subjects with SIRS, mild sepsis, severe sepsis.

Figure 243:
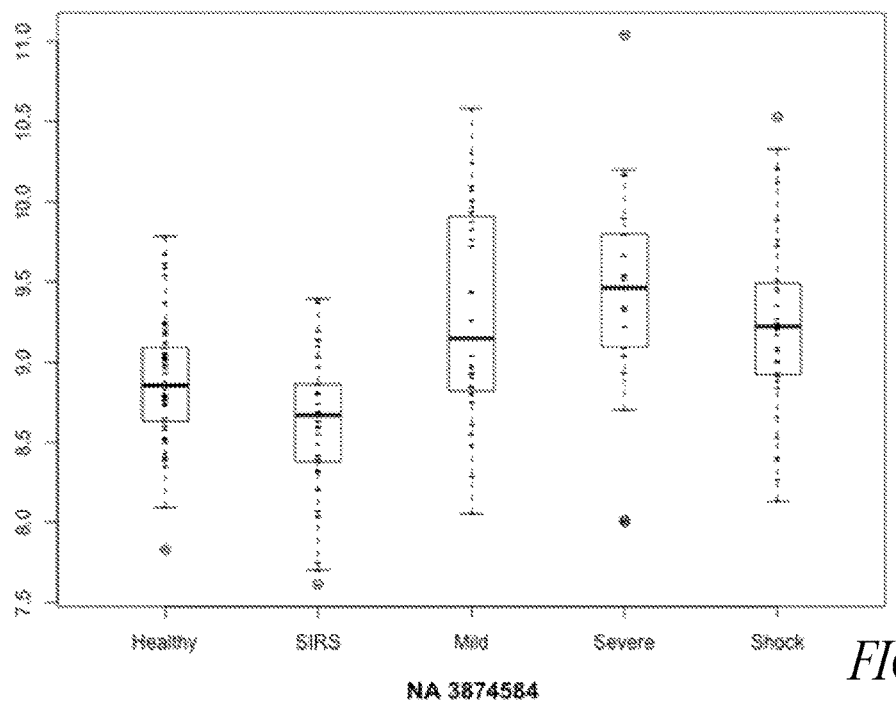

FIG. 243 shows a box and whiskers plot of PTGS1 gene expression for healthy subjects and subjects with SIRS, mild sepsis, severe sepsis.

Figure 244:
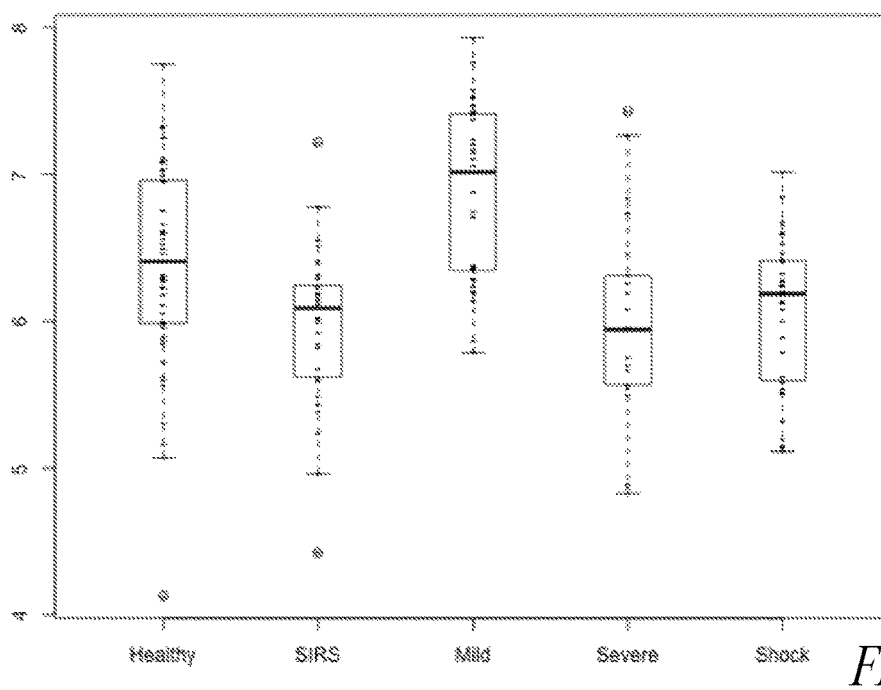

FIG. 244 shows a box and whiskers plot of NA gene expression for healthy subjects and subjects with SIRS, mild sepsis, severe sepsis.

Figure 245:
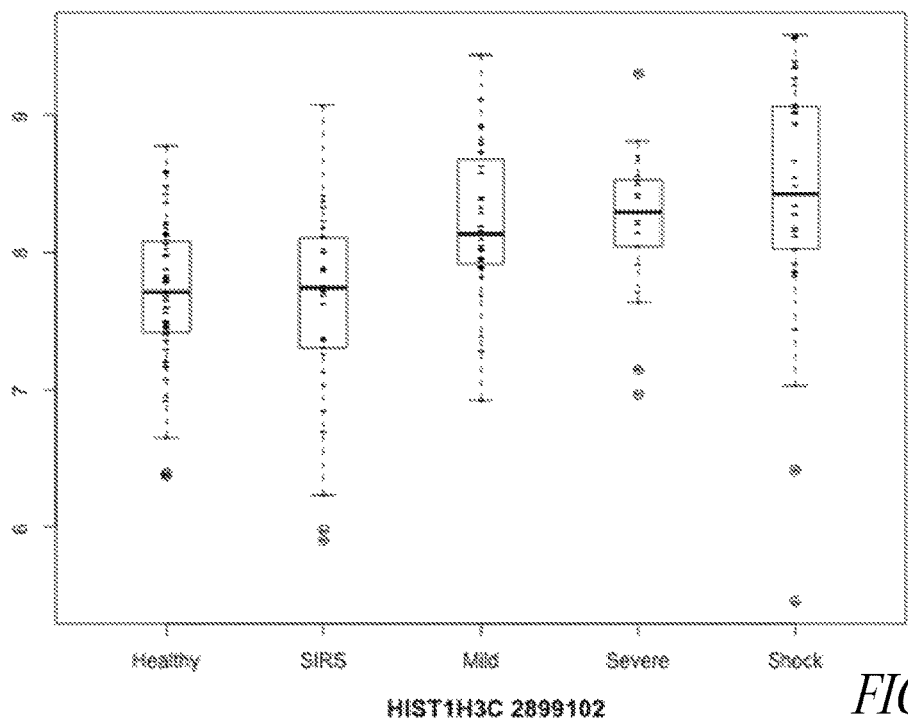

FIG. 245 shows a box and whiskers plot of UBE2F//C20orf194//SCLY gene expression for healthy subjects and subjects with SIRS, mild sepsis, severe sepsis.

Figure 246:
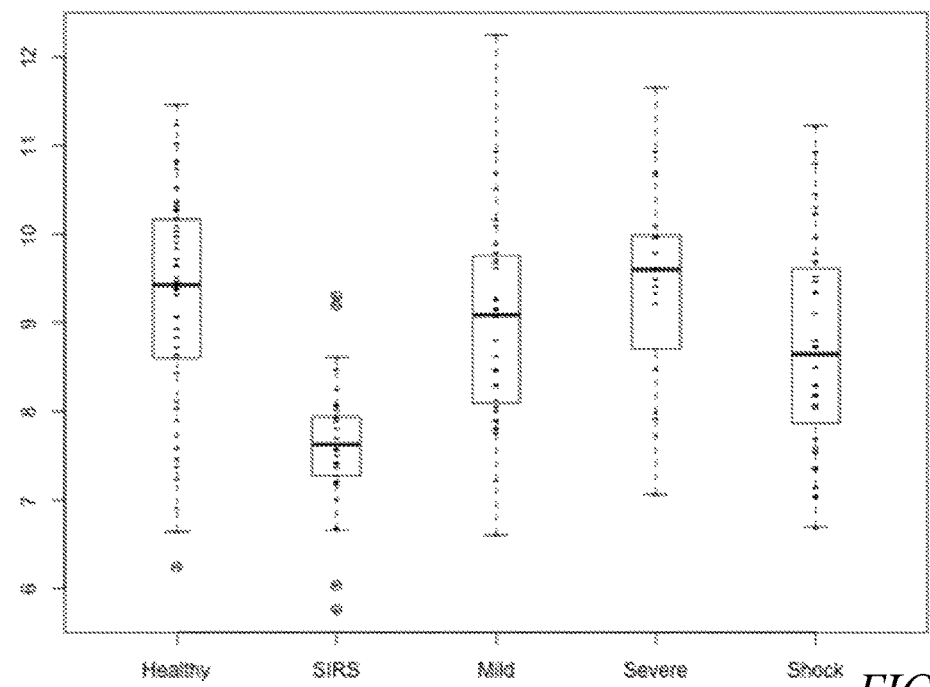

FIG. 246 shows a box and whiskers plot of HIST1H3C gene expression for healthy subjects and subjects with SIRS, mild sepsis, severe sepsis.

Figure 247:
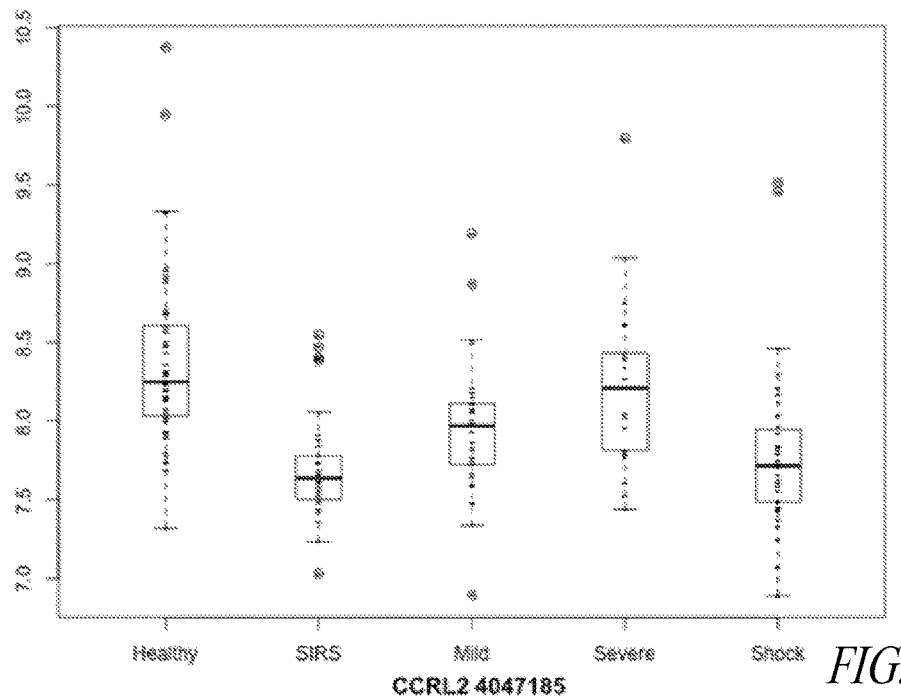

FIG. 247 shows a box and whiskers plot of FAM118A gene expression for healthy subjects and subjects with SIRS, mild sepsis, severe sepsis.

Figure 248:
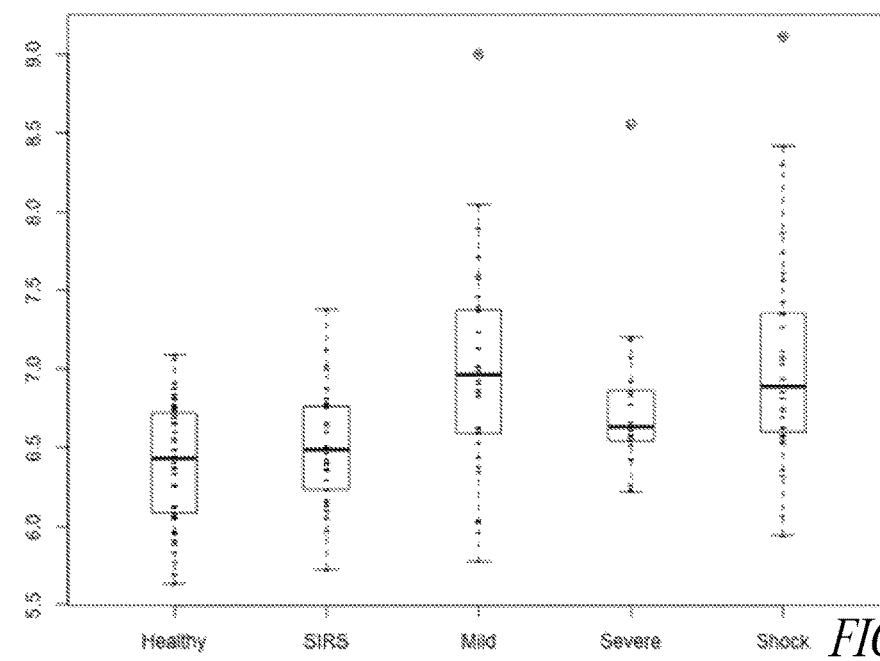

FIG. 248 shows a box and whiskers plot of CCRL2 gene expression for healthy subjects and subjects with SIRS, mild sepsis, severe sepsis.

Figure 249:
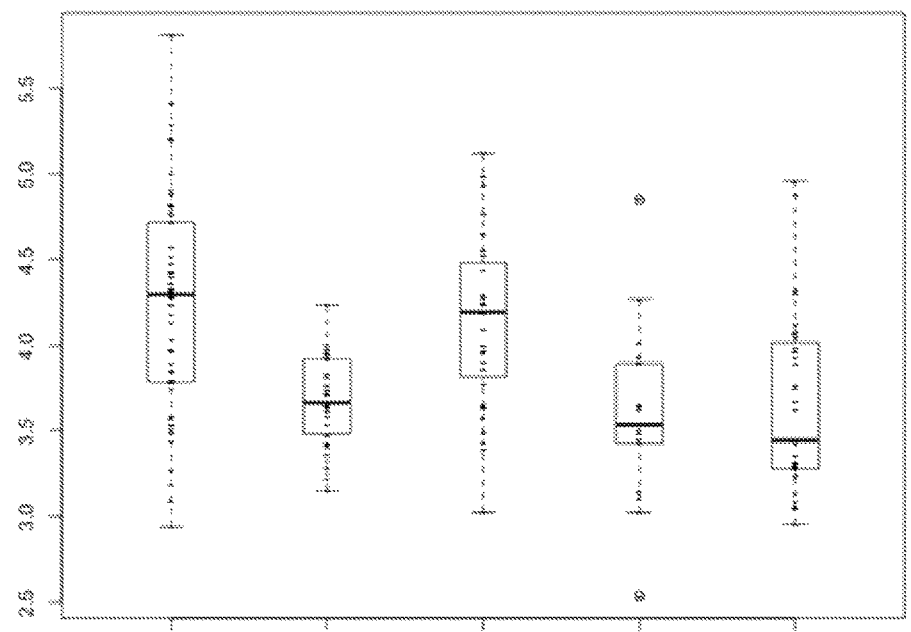

FIG. 249 shows a box and whiskers plot of E2F6 gene expression for healthy subjects and subjects with SIRS, mild sepsis, severe sepsis.

Figure 250:
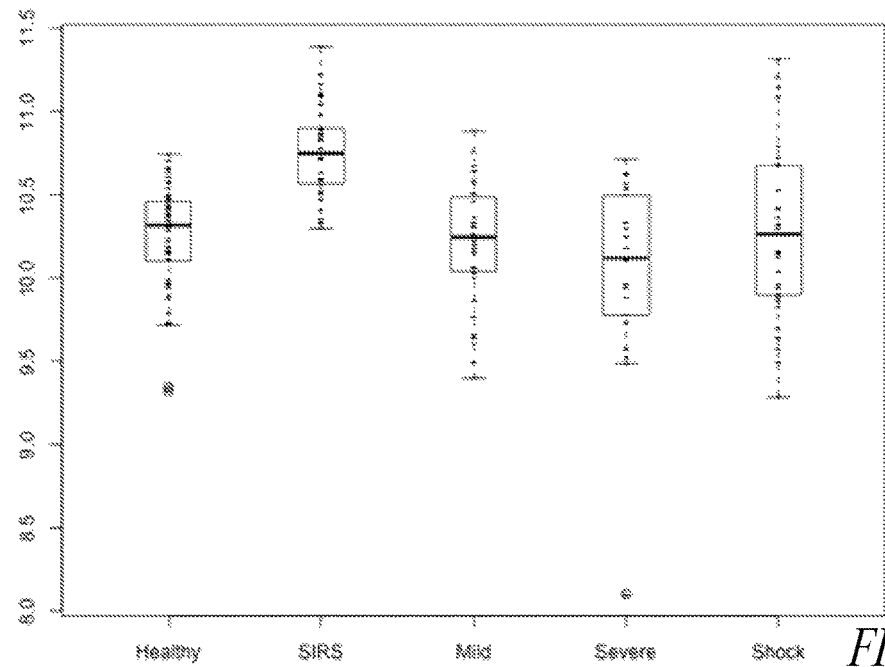

FIG. 250 shows a box and whiskers plot of MPZL3 gene expression for healthy subjects and subjects with SIRS, mild sepsis, severe sepsis.

Figure 251:
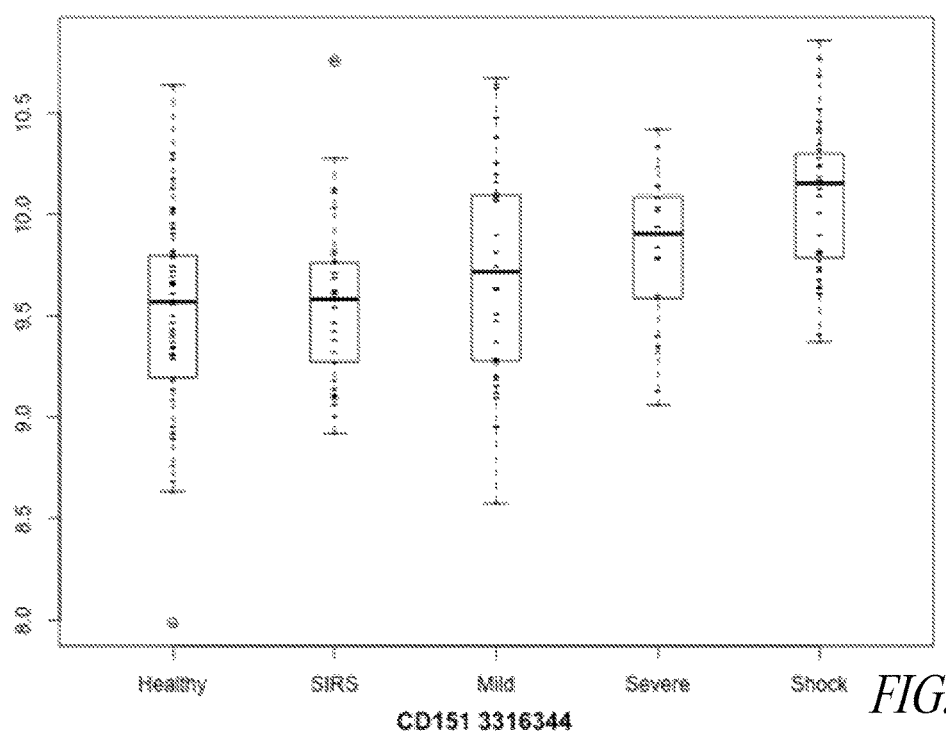

FIG. 251 shows a box and whiskers plot of SRXN1 gene expression for healthy subjects and subjects with SIRS, mild sepsis, severe sepsis.

Figure 252:
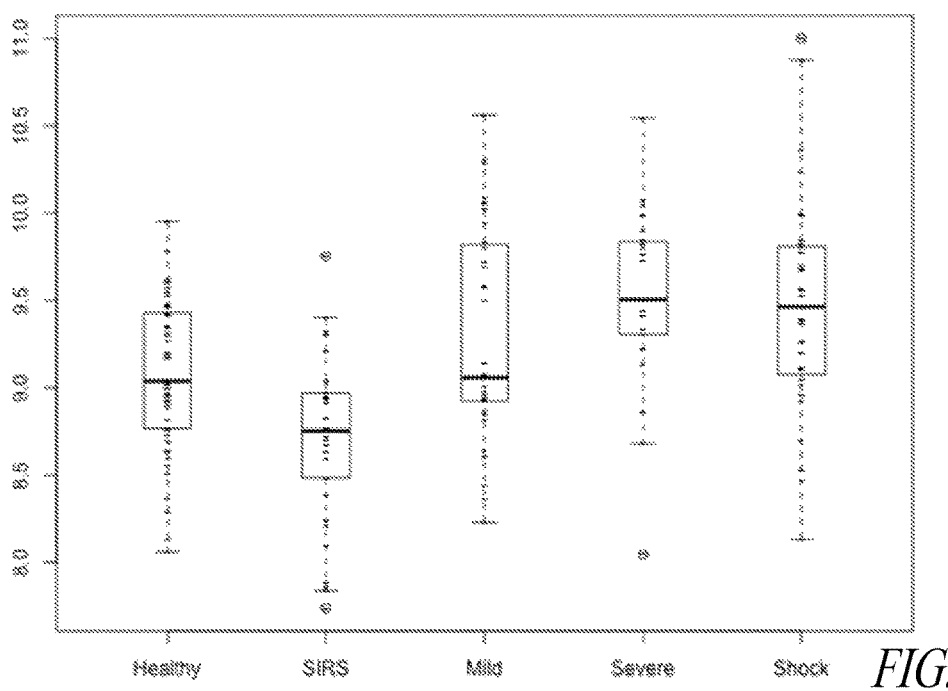

FIG. 252 shows a box and whiskers plot of CD151 gene expression for healthy subjects and subjects with SIRS, mild sepsis, severe sepsis.

Figure 253:
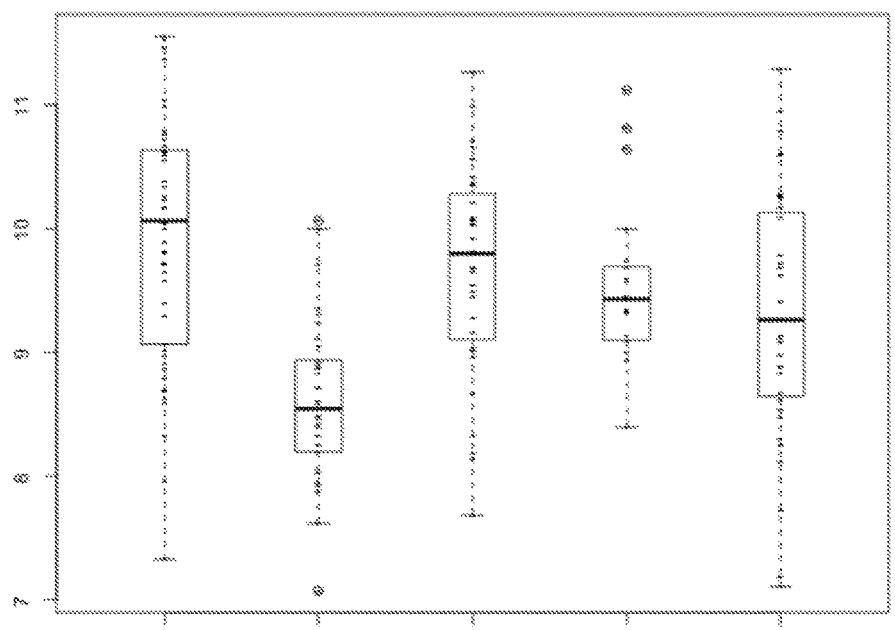

FIG. 253 shows a box and whiskers plot of HIST1H3H gene expression for healthy subjects and subjects with SIRS, mild sepsis, severe sepsis.

Figure 254:
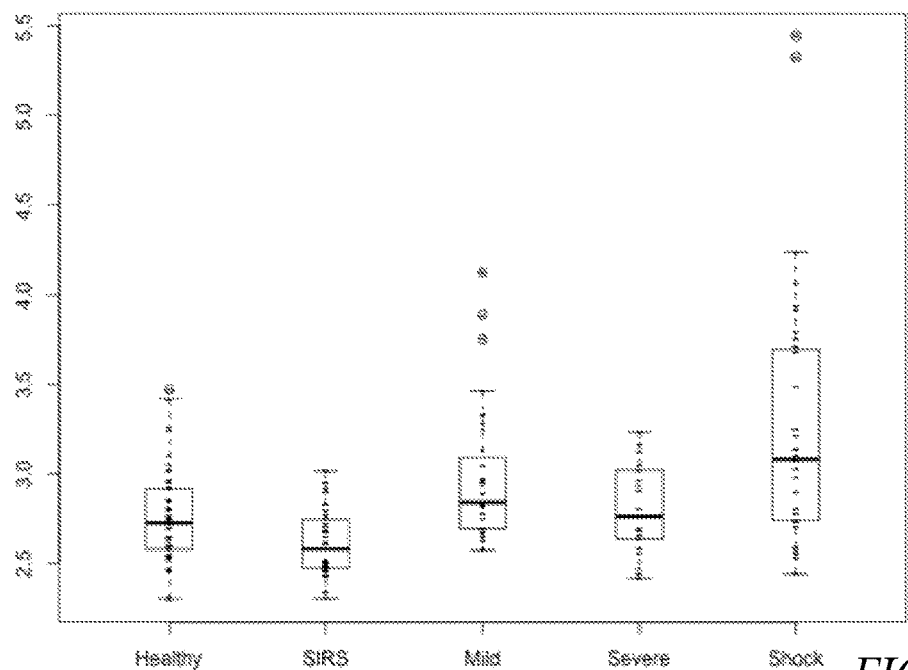

FIG. 254 shows a box and whiskers plot of FSD1L gene expression for healthy subjects and subjects with SIRS, mild sepsis, severe sepsis.

Figure 255:
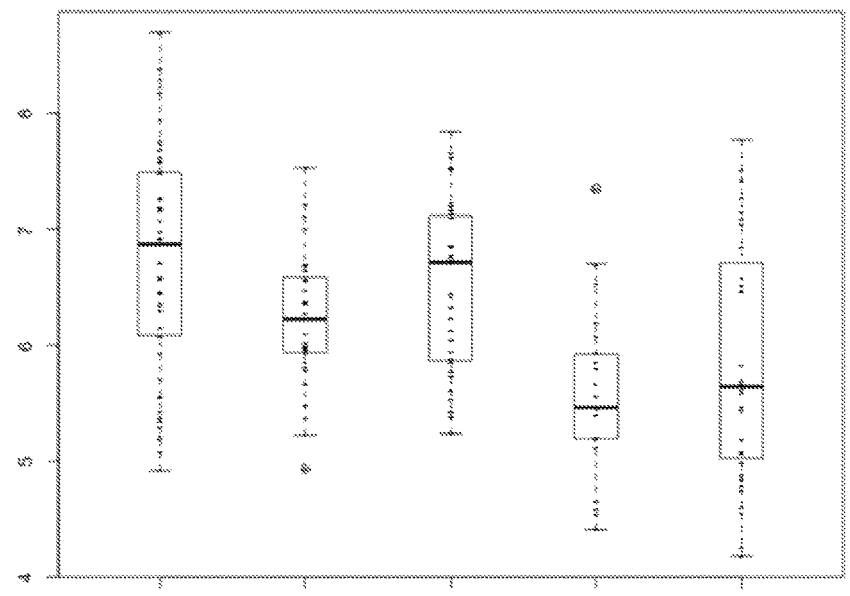

FIG. 255 shows a box and whiskers plot of RFESD//SPATA9 gene expression for healthy subjects and subjects with SIRS, mild sepsis, severe sepsis.

Figure 256:
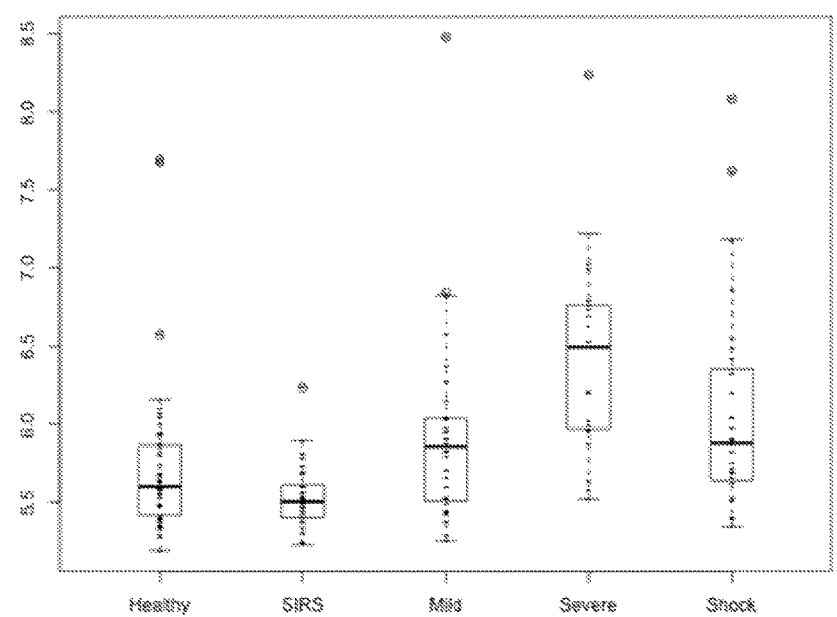

FIG. 256 shows a box and whiskers plot of TPX2 gene expression for healthy subjects and subjects with SIRS, mild sepsis, severe sepsis.

Figure 257:
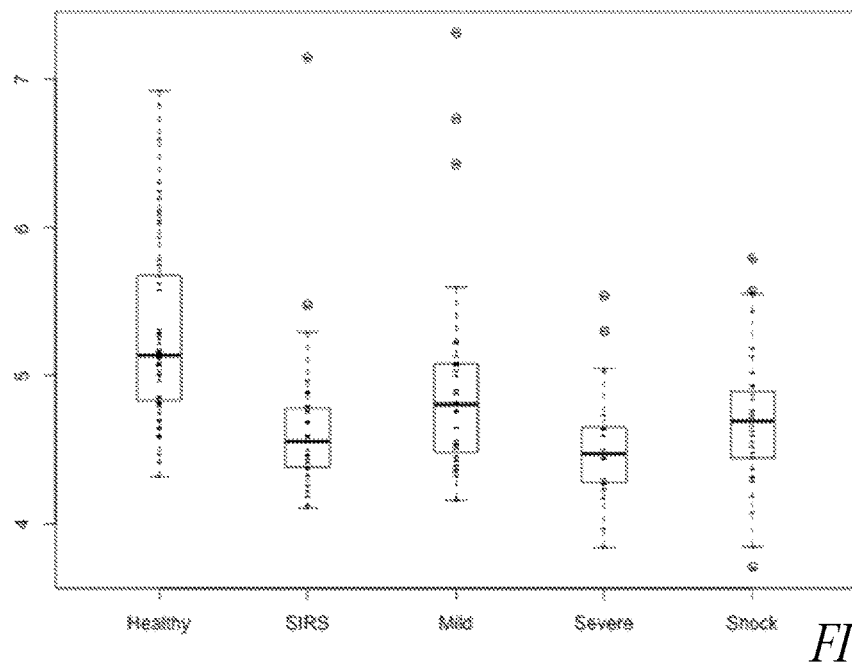

FIG. 257 shows a box and whiskers plot of S100B gene expression for healthy subjects and subjects with SIRS, mild sepsis, severe sepsis.

Figure 258:
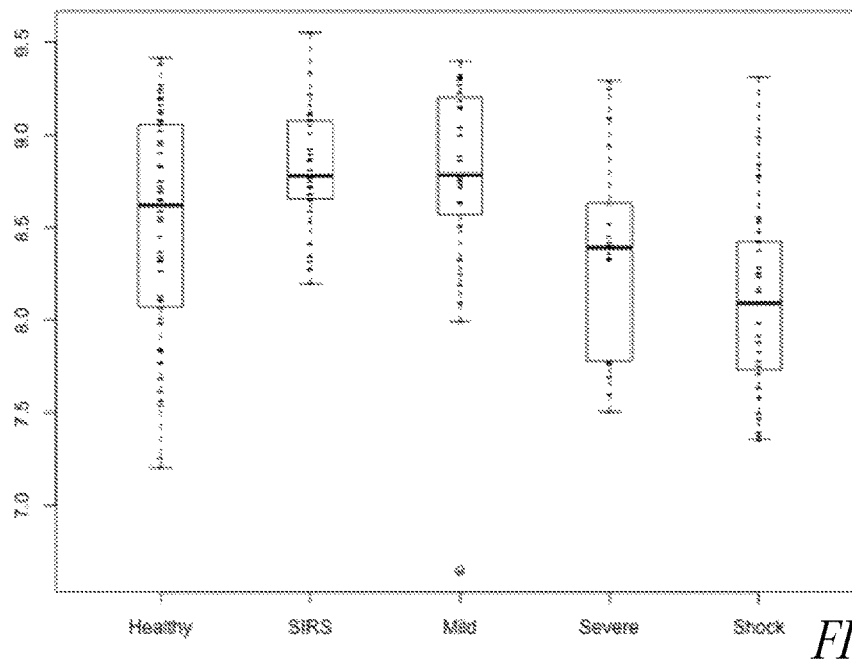

FIG. 258 shows a box and whiskers plot of ZNF587//ZNF417 gene expression for healthy subjects and subjects with SIRS, mild sepsis, severe sepsis.

Figure 259:
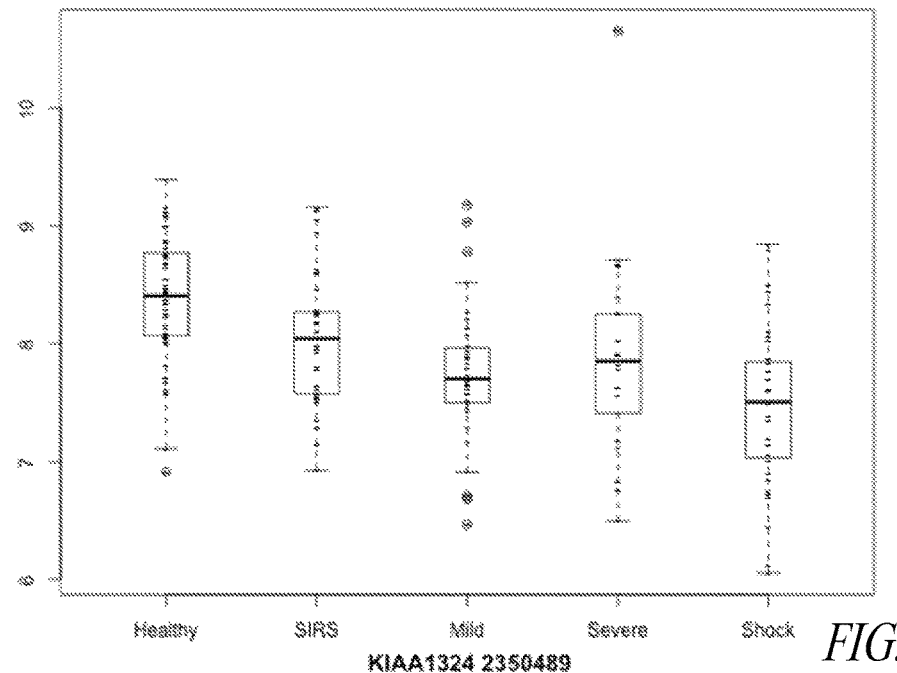

FIG. 259 shows a box and whiskers plot of PYHIN1 gene expression for healthy subjects and subjects with SIRS, mild sepsis, severe sepsis.

Figure 260:
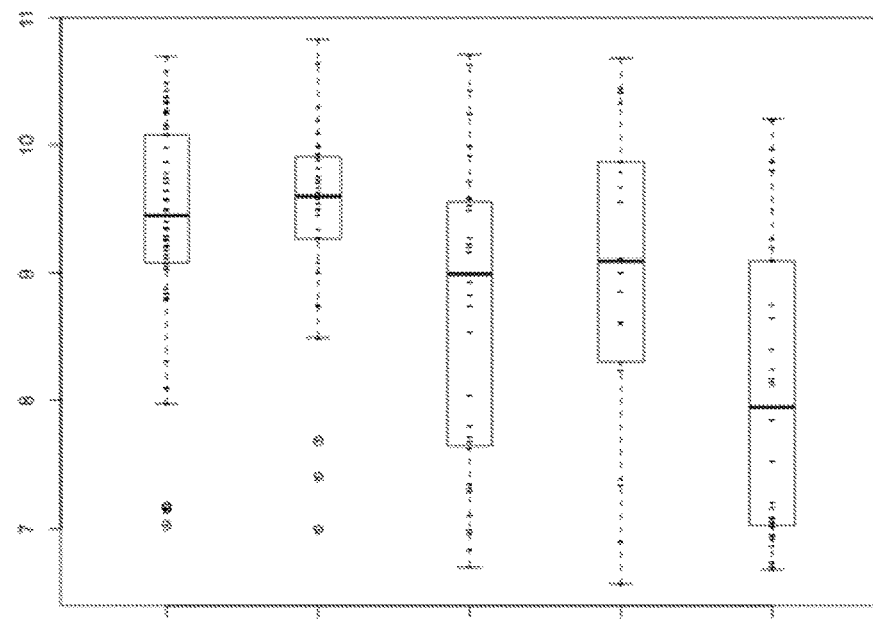

FIG. 260 shows a box and whiskers plot of KIAA1324 gene expression for healthy subjects and subjects with SIRS, mild sepsis, severe sepsis.

Figure 261:
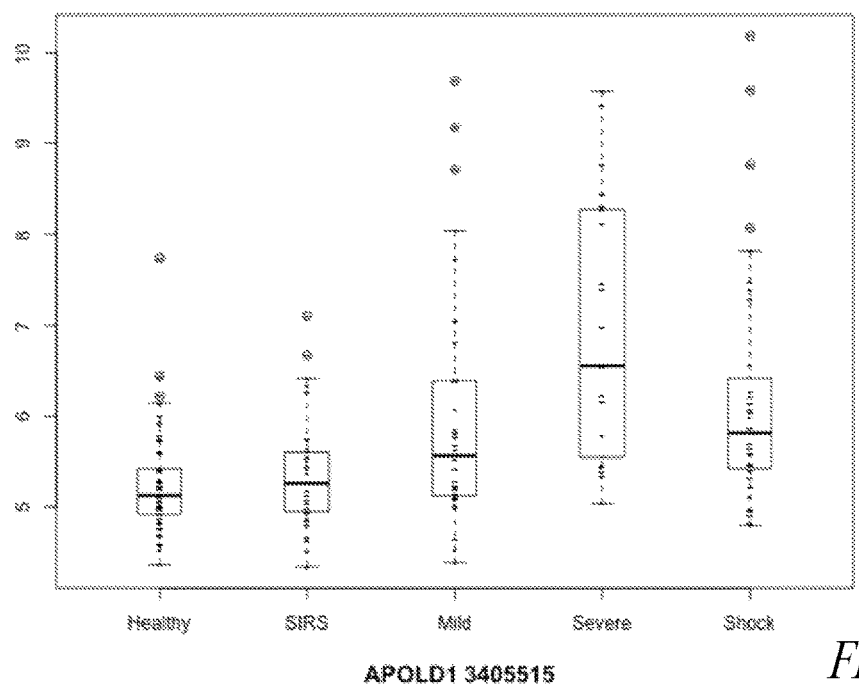

FIG. 261 shows a box and whiskers plot of CEACAM6//CEACAM5 gene expression for healthy subjects and subjects with SIRS, mild sepsis, severe sepsis.

Figure 262:
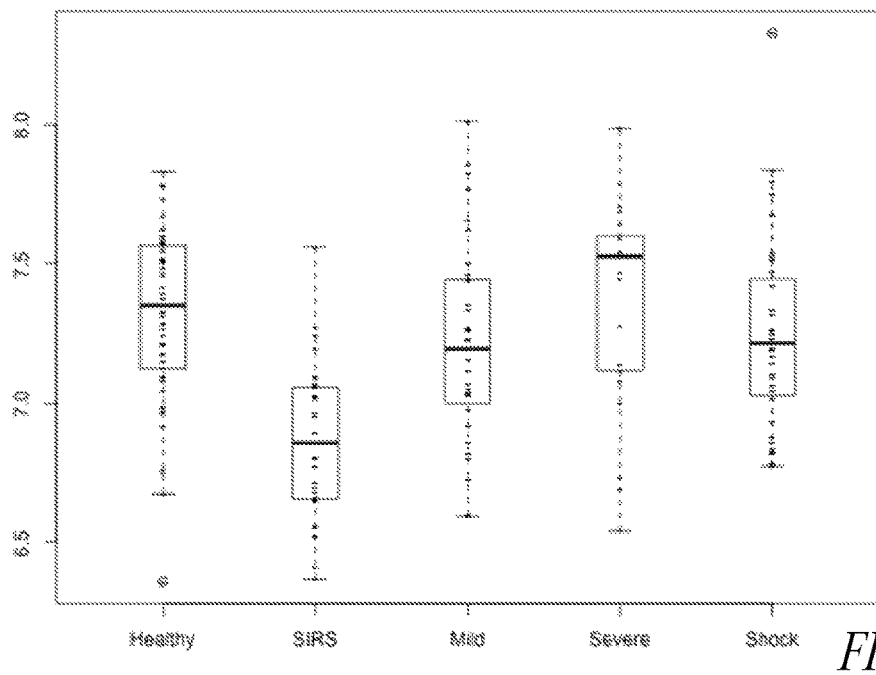

FIG. 262 shows a box and whiskers plot of APOLD1 gene expression for healthy subjects and subjects with SIRS, mild sepsis, severe sepsis.

Figure 263:
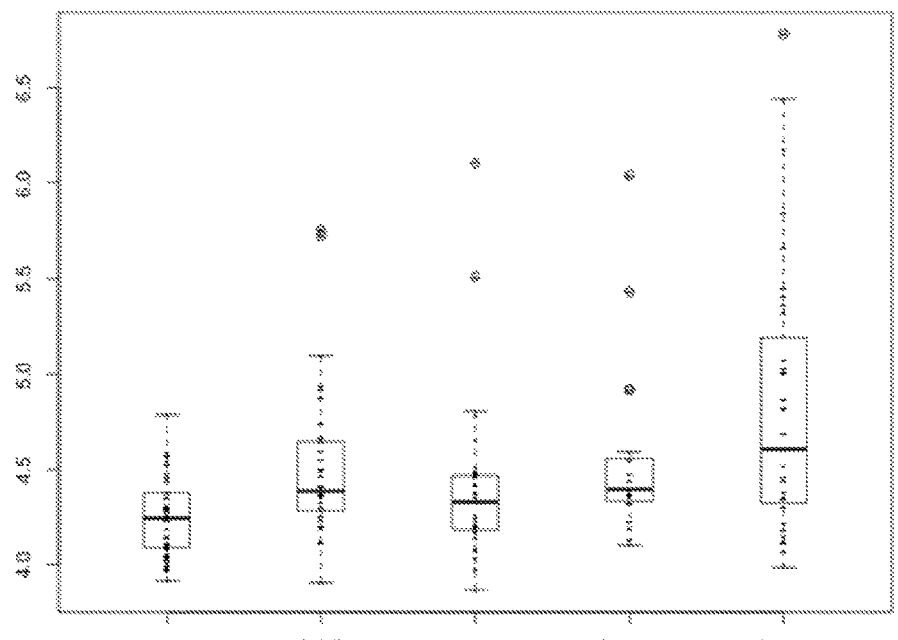

FIG. 263 shows a box and whiskers plot of FABP2 gene expression for healthy subjects and subjects with SIRS, mild sepsis, severe sepsis.

Figure 264:
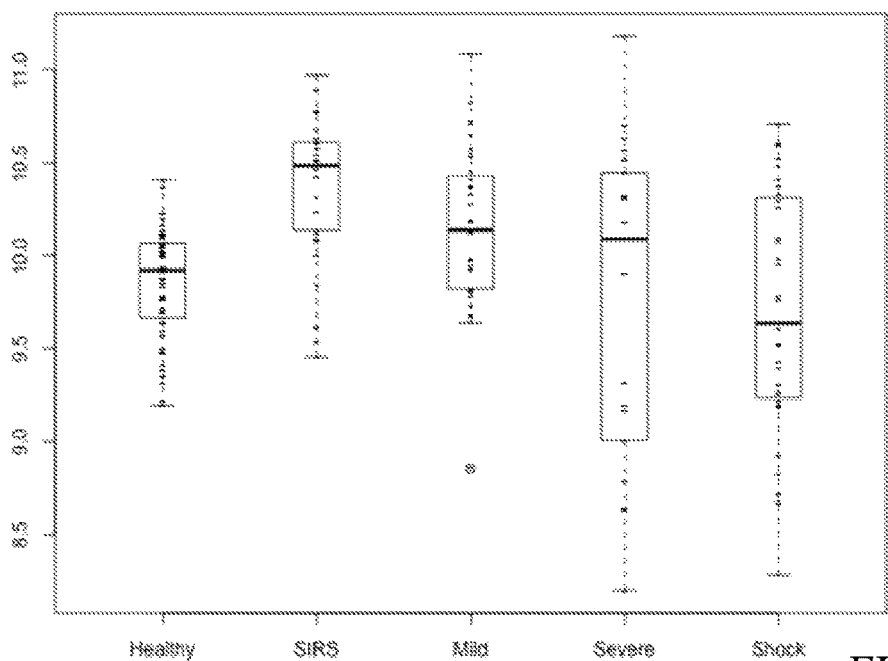

FIG. 264 shows a box and whiskers plot of KDM6B//TMEM88 gene expression for healthy subjects and subjects with SIRS, mild sepsis, severe sepsis.

Figure 265:
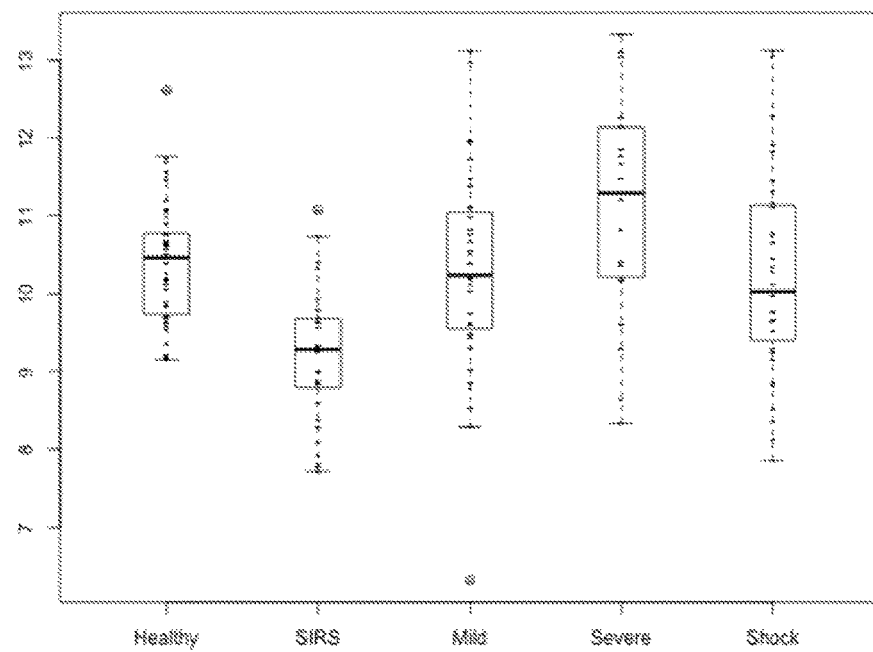

FIG. 265 shows a box and whiskers plot of IGKV3-20//IGKV3D-15//LOC440871//LOC652493//LOC100291464//LOC652694//IGKV3-15 gene expression for healthy subjects and subjects with SIRS, mild sepsis, severe sepsis.

Figure 266:
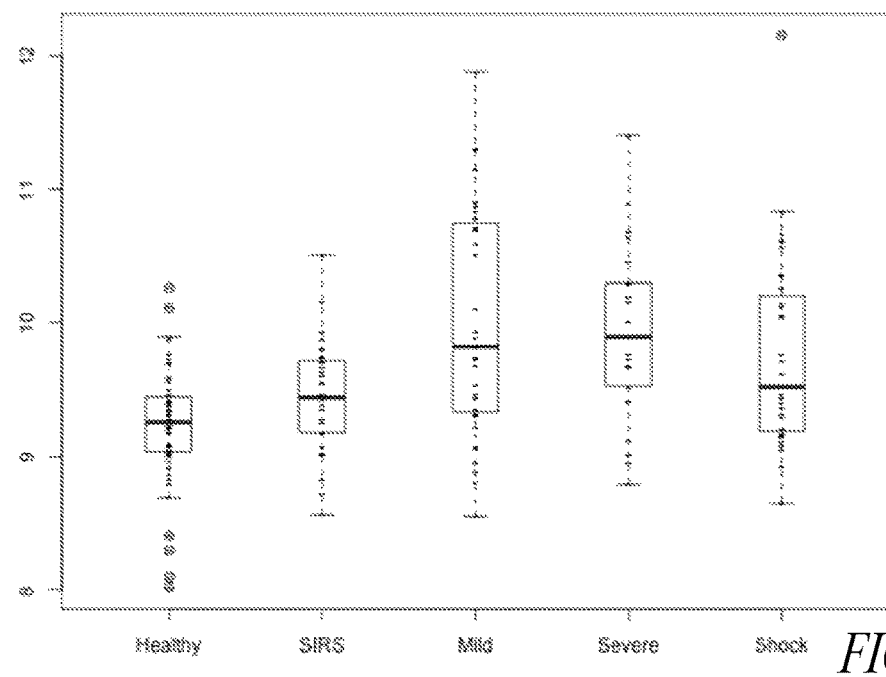

FIG. 266 shows a box and whiskers plot of MYL9 gene expression for healthy subjects and subjects with SIRS, mild sepsis, severe sepsis.

Figure 267:
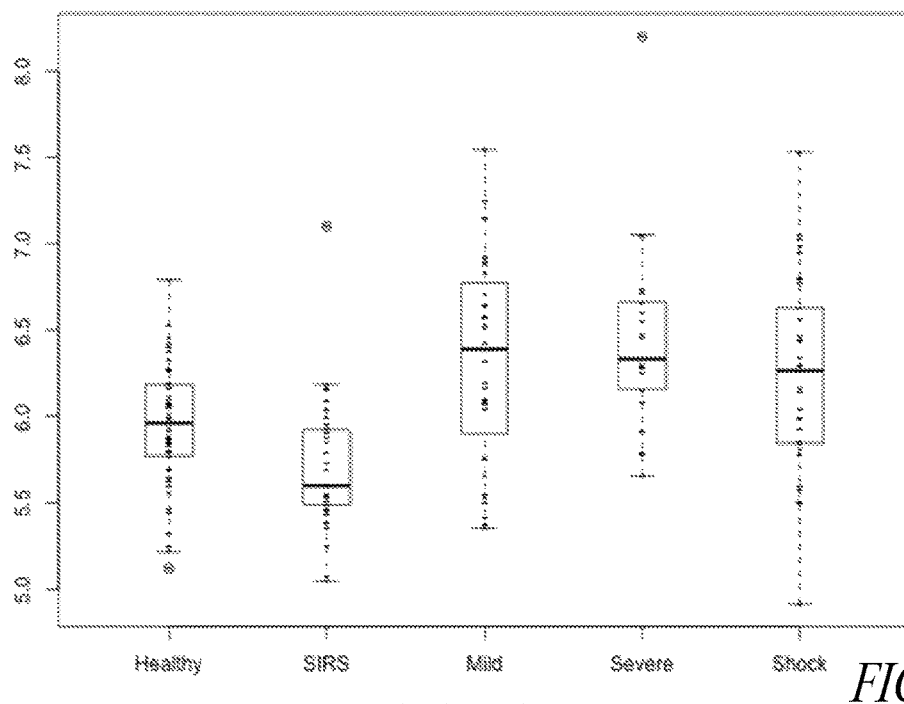

FIG. 267 shows a box and whiskers plot of HIST1H2BJ gene expression for healthy subjects and subjects with SIRS, mild sepsis, severe sepsis.

Figure 268:
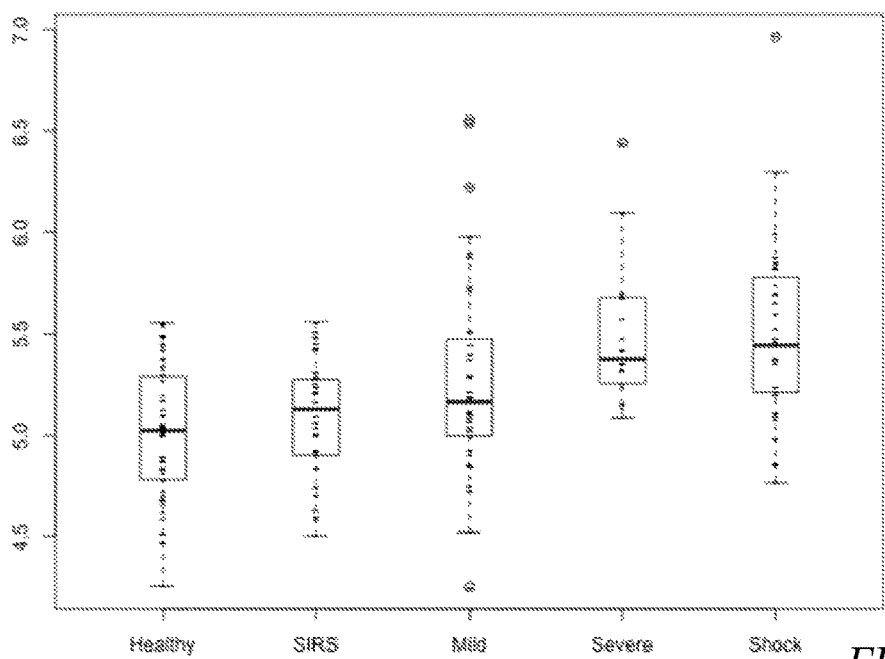

FIG. 268 shows a box and whiskers plot of TAAR1 gene expression for healthy subjects and subjects with SIRS, mild sepsis, severe sepsis.

Figure 269:
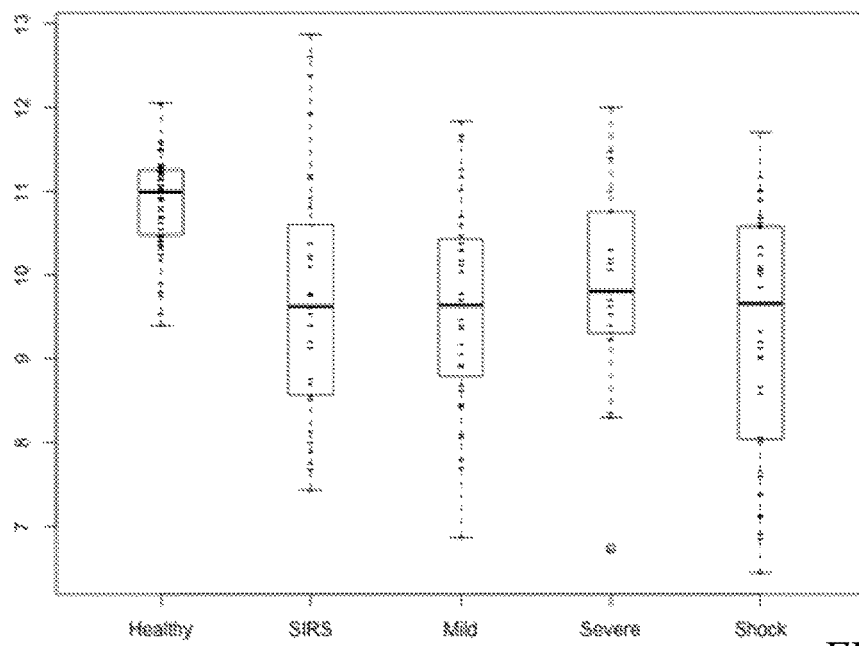

FIG. 269 shows a box and whiskers plot of CLC gene expression for healthy subjects and subjects with SIRS, mild sepsis, severe sepsis.

Figure 270:
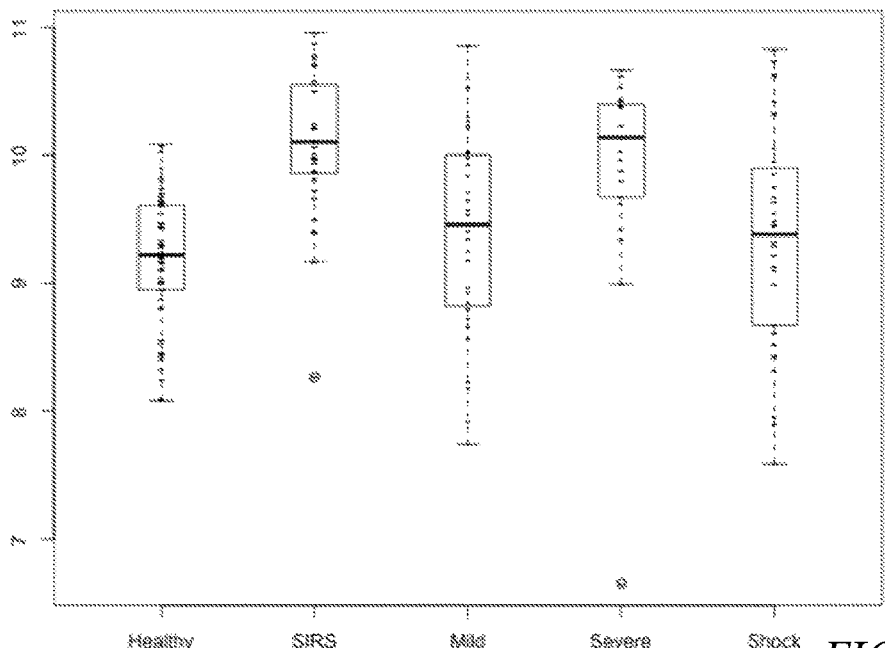

FIG. 270 shows a box and whiskers plot of CYP4F3//CYP4F2 gene expression for healthy subjects and subjects with SIRS, mild sepsis, severe sepsis.

Figure 271:
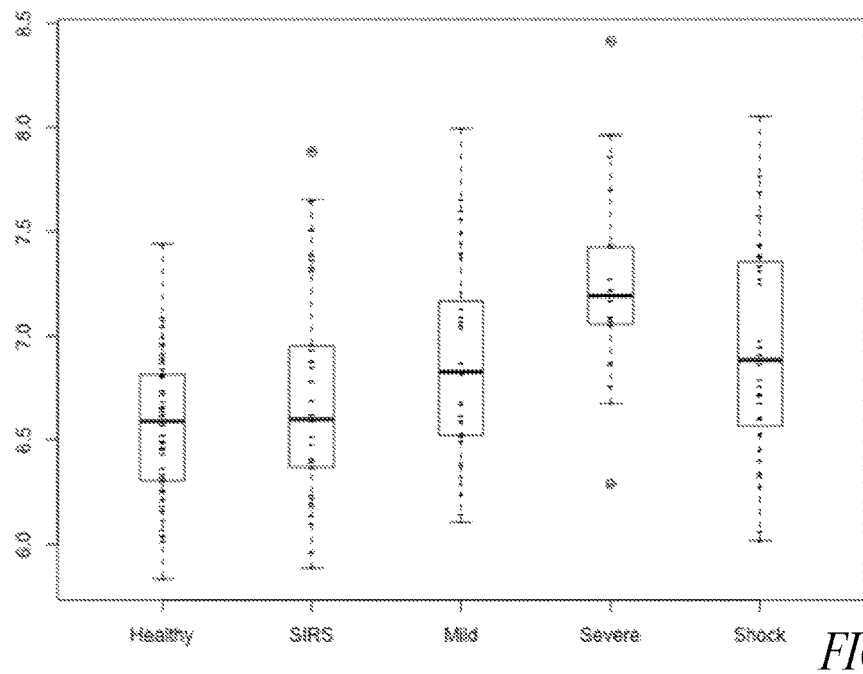

FIG. 271 shows a box and whiskers plot of CEP97 gene expression for healthy subjects and subjects with SIRS, mild sepsis, severe sepsis.

Figure 272:
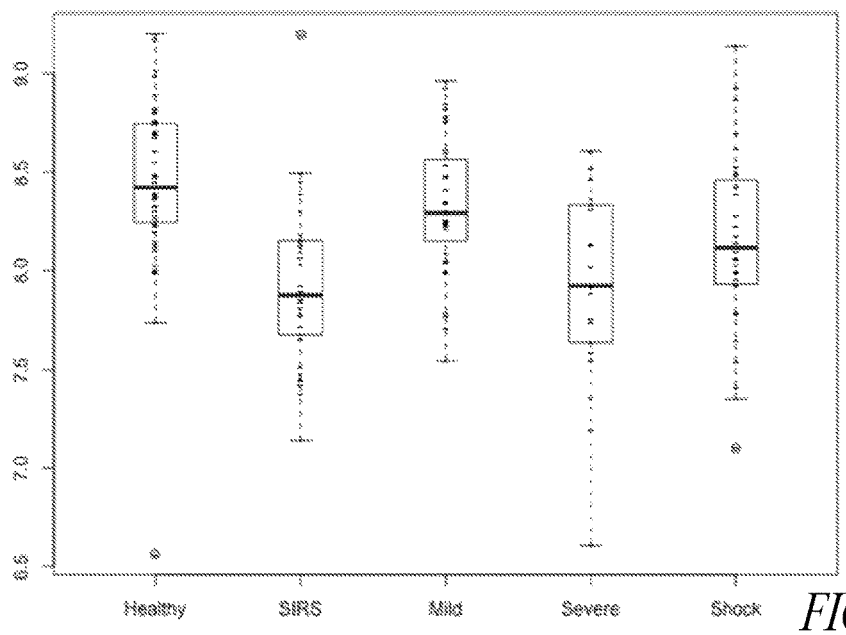

FIG. 272 shows a box and whiskers plot of SON gene expression for healthy subjects and subjects with SIRS, mild sepsis, severe sepsis.

Figure 273:
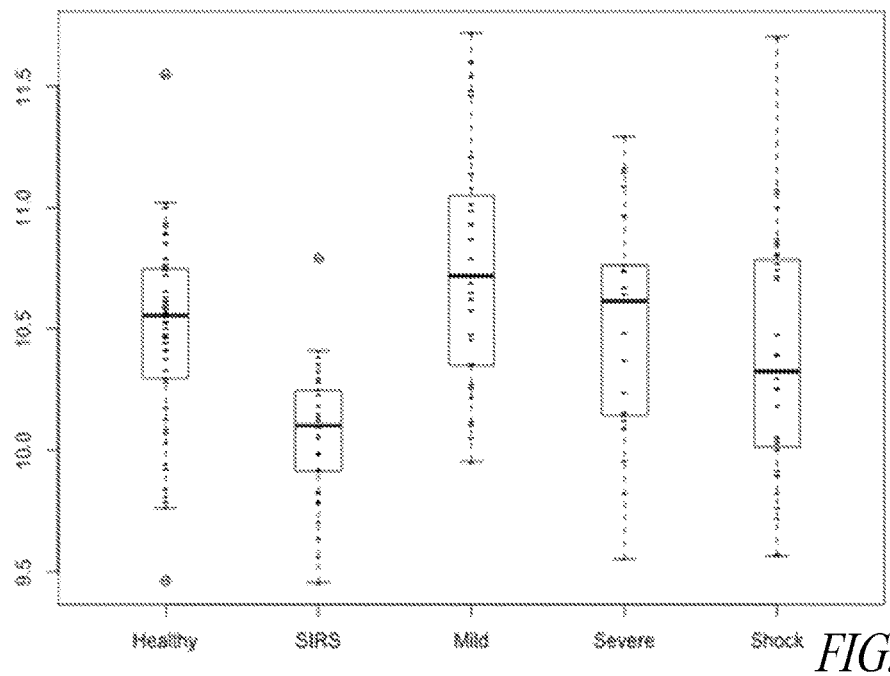

FIG. 273 shows a box and whiskers plot of IRF1 gene expression for healthy subjects and subjects with SIRS, mild sepsis, severe sepsis.

Figure 274:
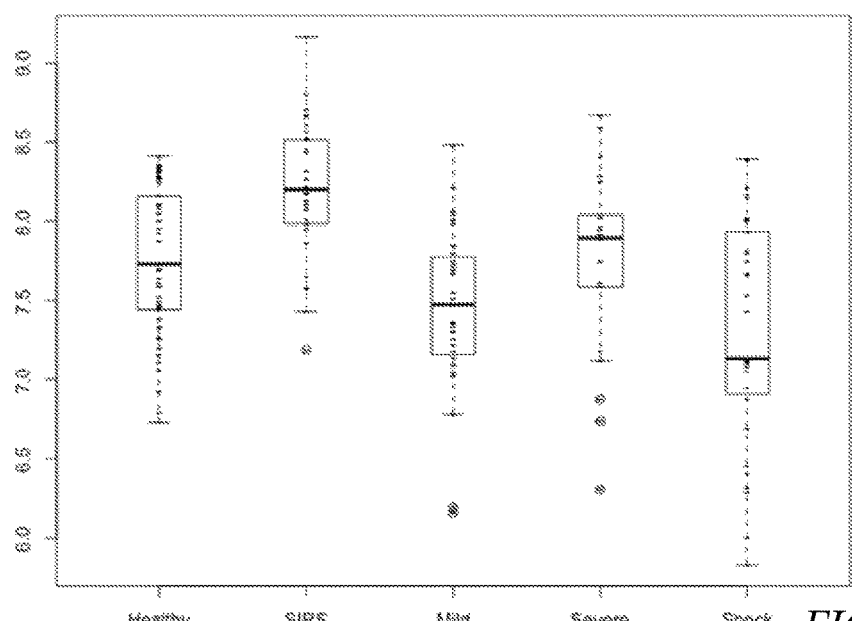

FIG. 274 shows a box and whiskers plot of SYNE2 gene expression for healthy subjects and subjects with SIRS, mild sepsis, severe sepsis.

Figure 275:
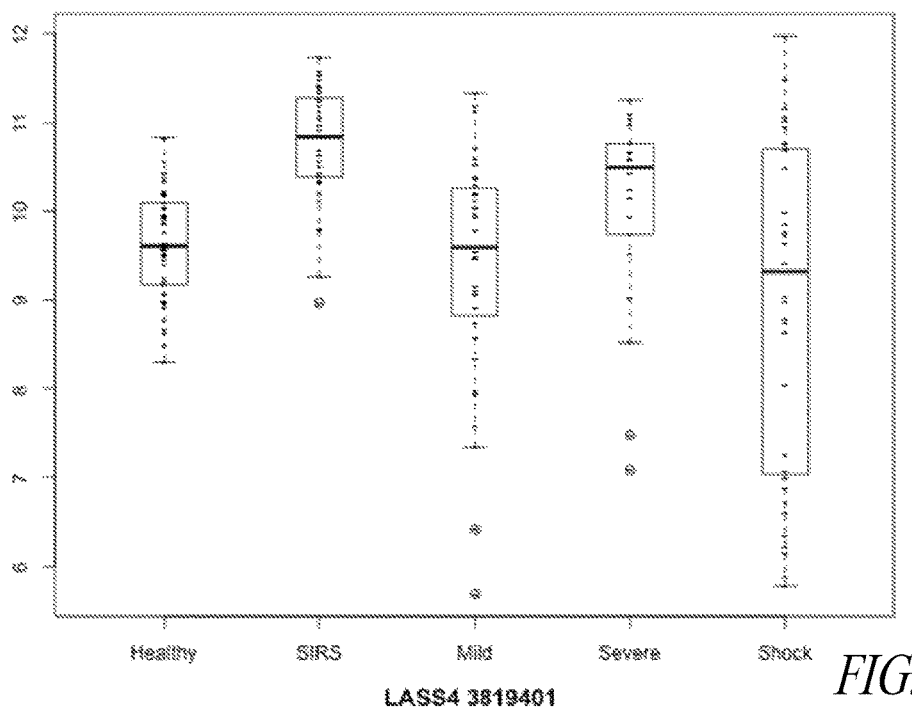

FIG. 275 shows a box and whiskers plot of MME gene expression for healthy subjects and subjects with SIRS, mild sepsis, severe sepsis.

Figure 276:
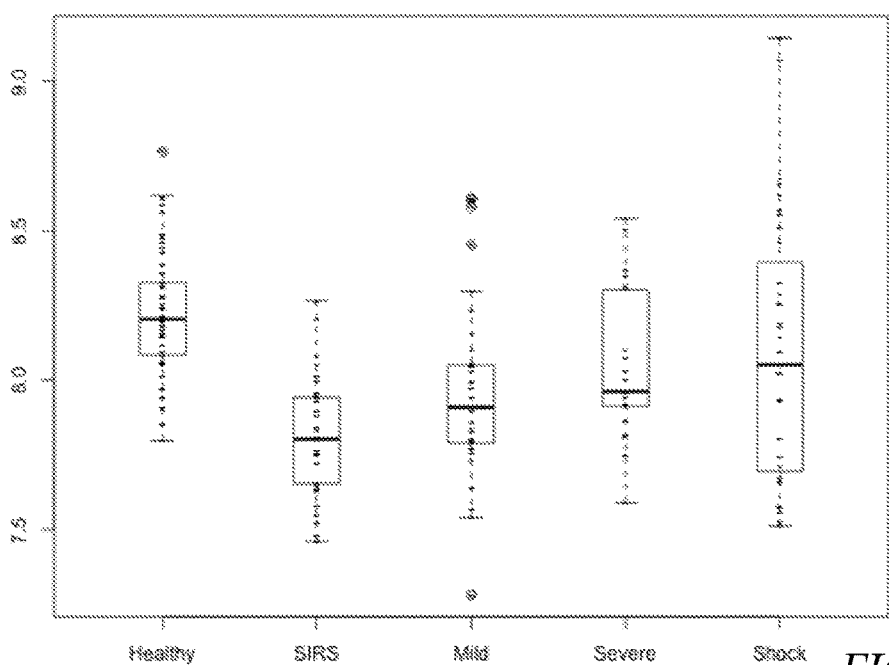

FIG. 276 shows a box and whiskers plot of LASS4 gene expression for healthy subjects and subjects with SIRS, mild sepsis, severe sepsis.

Figure 277:
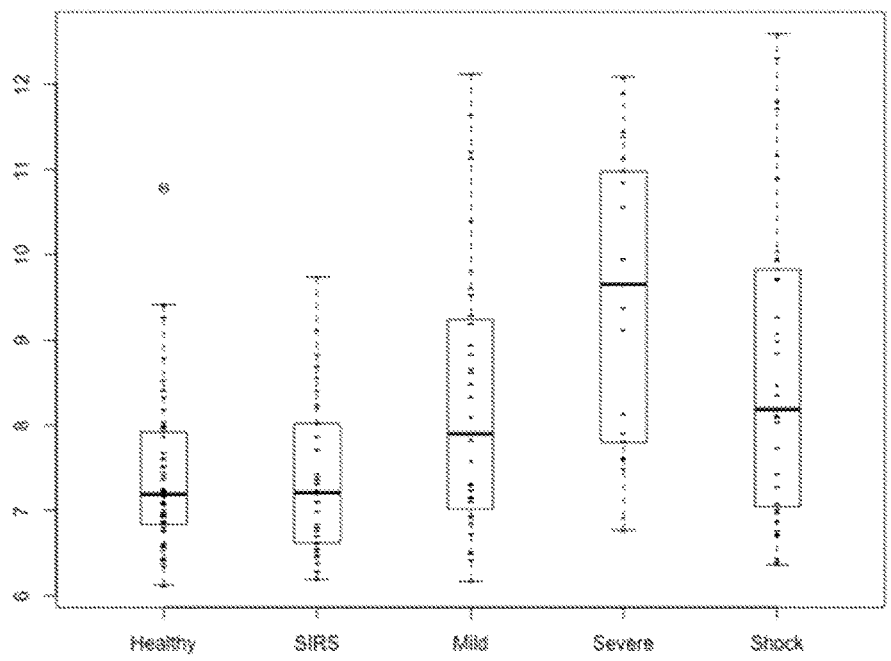

FIG. 277 shows a box and whiskers plot of DEFA4//DEFA8P gene expression for healthy subjects and subjects with SIRS, mild sepsis, severe sepsis.

Figure 278:
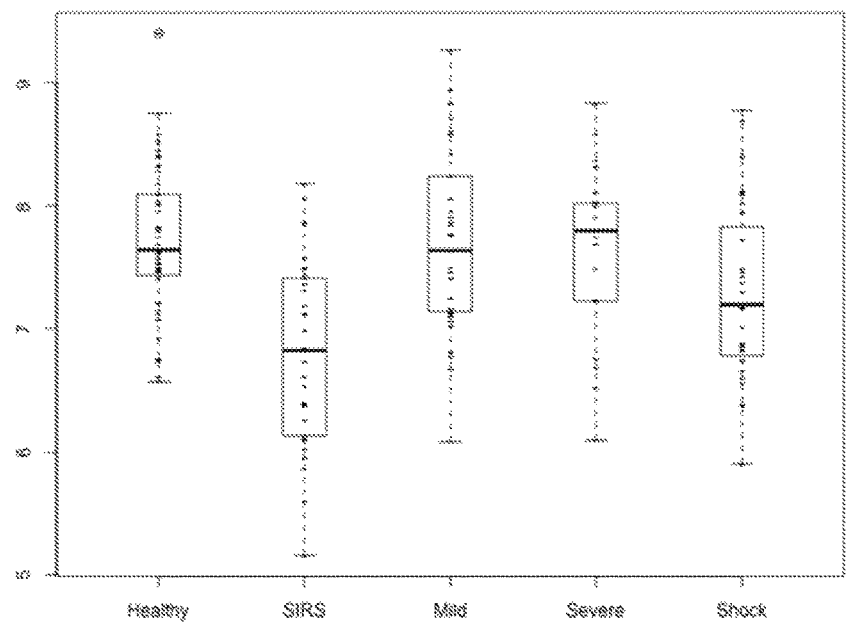

FIG. 278 shows a box and whiskers plot of C7orf58 gene expression for healthy subjects and subjects with SIRS, mild sepsis, severe sepsis.

Figure 279:
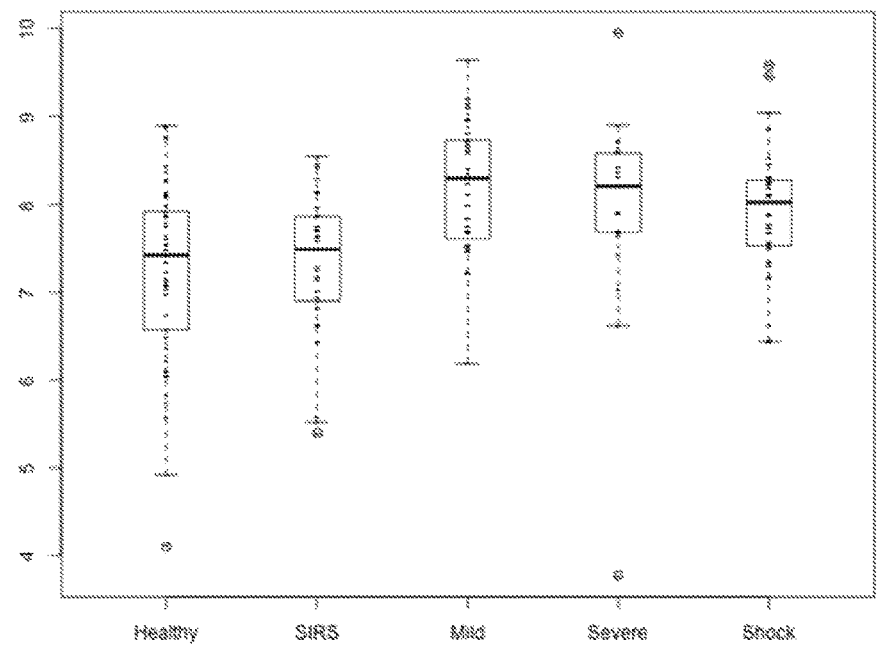

FIG. 279 shows a box and whiskers plot of DYNLL1 gene expression for healthy subjects and subjects with SIRS, mild sepsis, severe sepsis.

Figure 280:
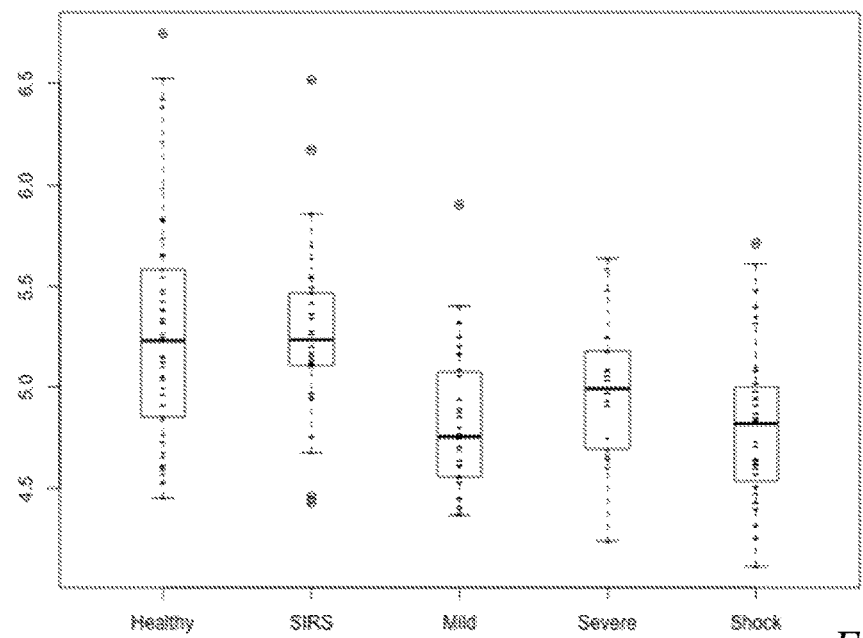

FIG. 280 shows a box and whiskers plot of NA gene expression for healthy subjects and subjects with SIRS, mild sepsis, severe sepsis.

Figure 281:
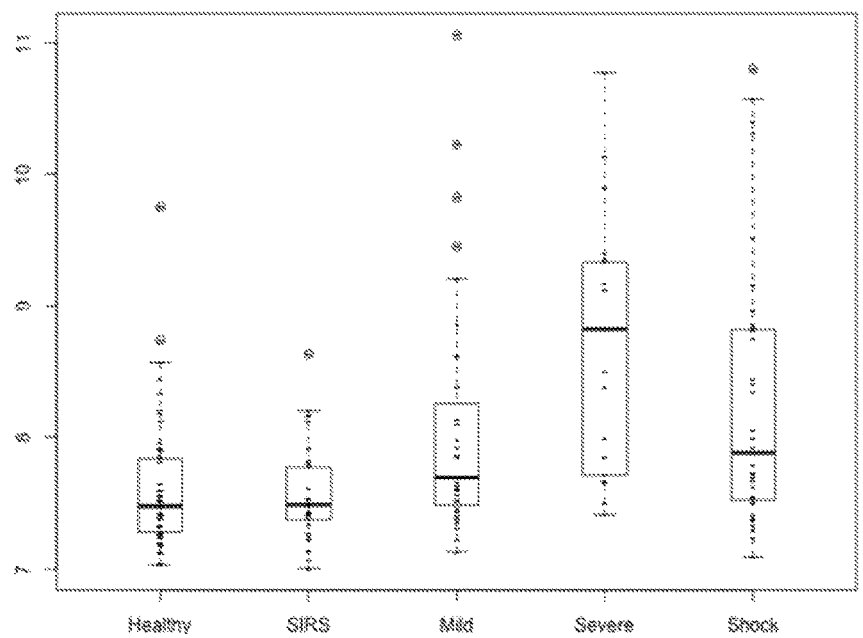

FIG. 281 shows a box and whiskers plot of MPO gene expression for healthy subjects and subjects with SIRS, mild sepsis, severe sepsis.

Figure 282:
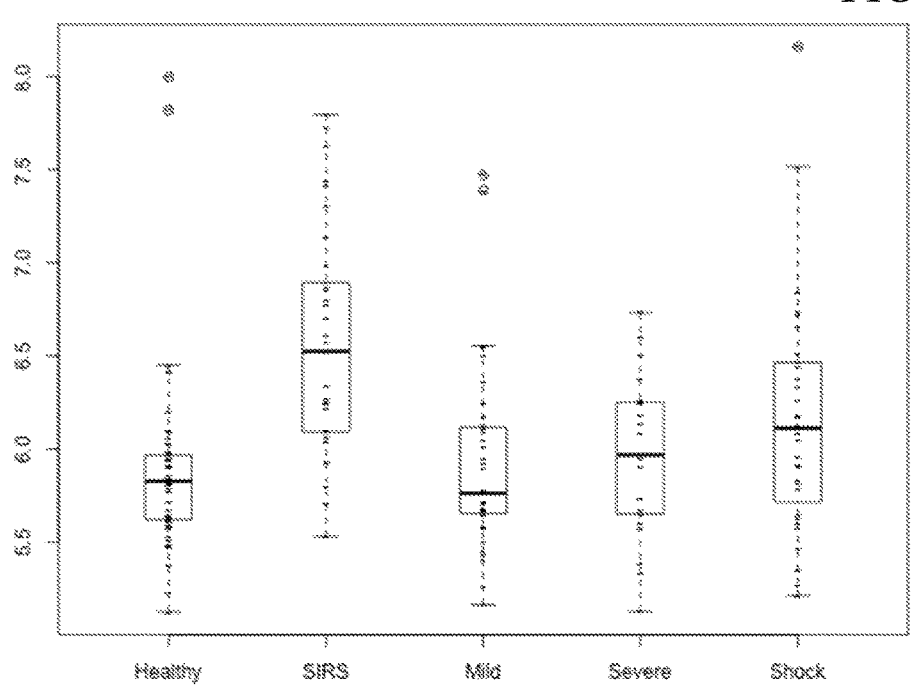

FIG. 282 shows a box and whiskers plot of CPM gene expression for healthy subjects and subjects with SIRS, mild sepsis, severe sepsis.

Figure 283:
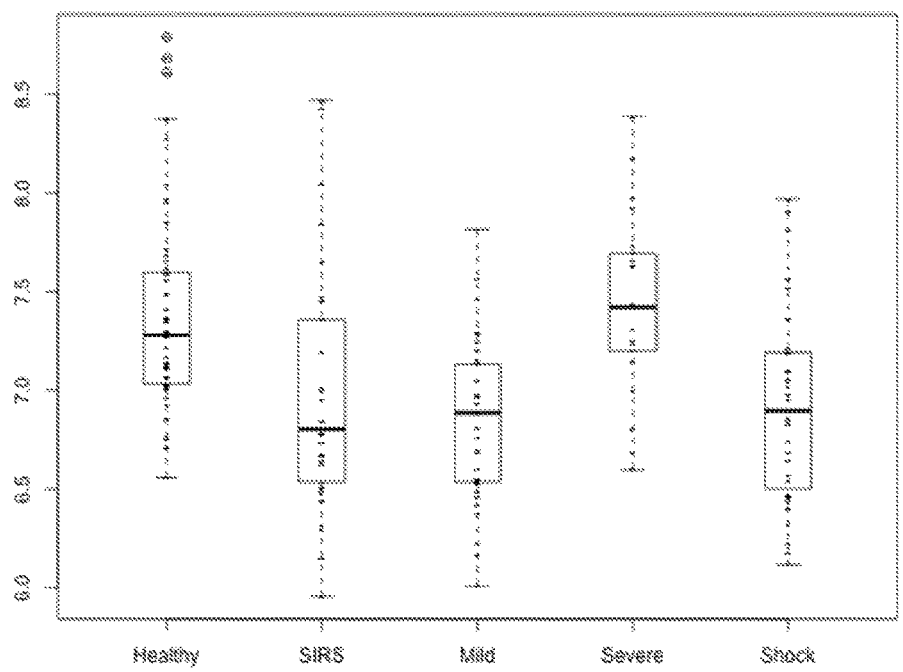

FIG. 283 shows a box and whiskers plot of TSHZ2 gene expression for healthy subjects and subjects with SIRS, mild sepsis, severe sepsis.

Figure 284:
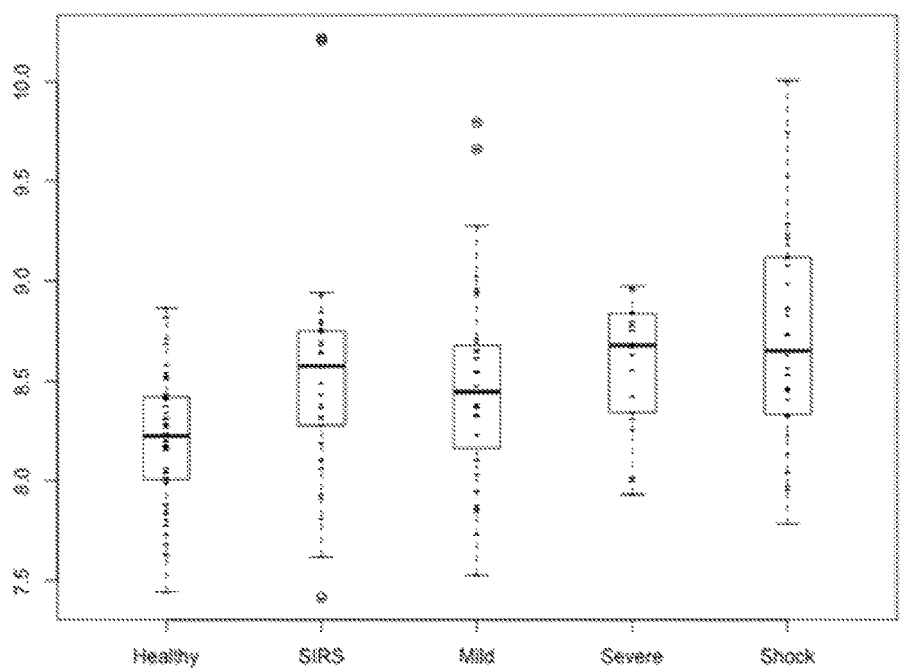

FIG. 284 shows a box and whiskers plot of PLIN2 gene expression for healthy subjects and subjects with SIRS, mild sepsis, severe sepsis.

Figure 285:
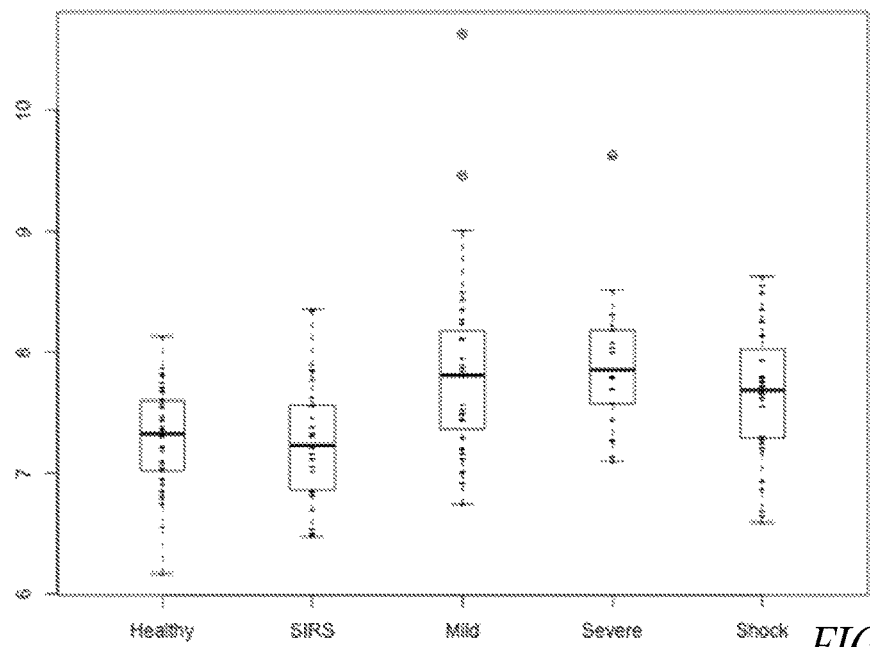

FIG. 285 shows a box and whiskers plot of FAM118B gene expression for healthy subjects and subjects with SIRS, mild sepsis, severe sepsis.

Figure 286:
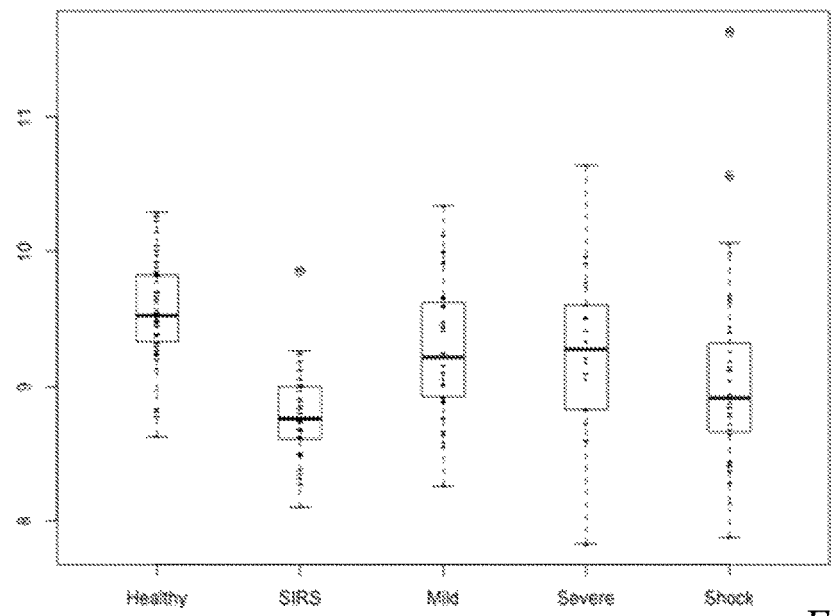

FIG. 286 shows a box and whiskers plot of B4GALT3 gene expression for healthy subjects and subjects with SIRS, mild sepsis, severe sepsis.

Figure 287:
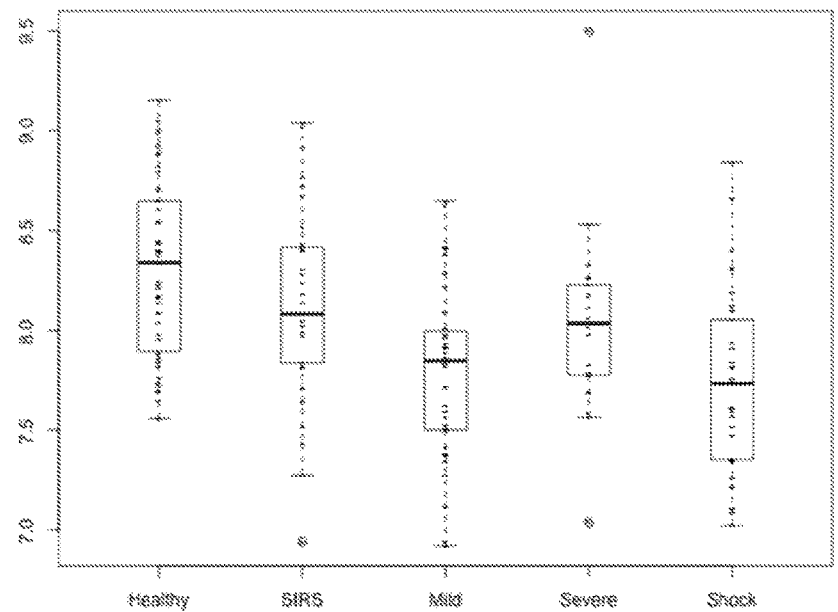

FIG. 287 shows a box and whiskers plot of RASA4//RASA4P//RASA4B//POLR2J4//LOC100132214 gene expression for healthy subjects and subjects with SIRS, mild sepsis, severe sepsis.

Figure 288:
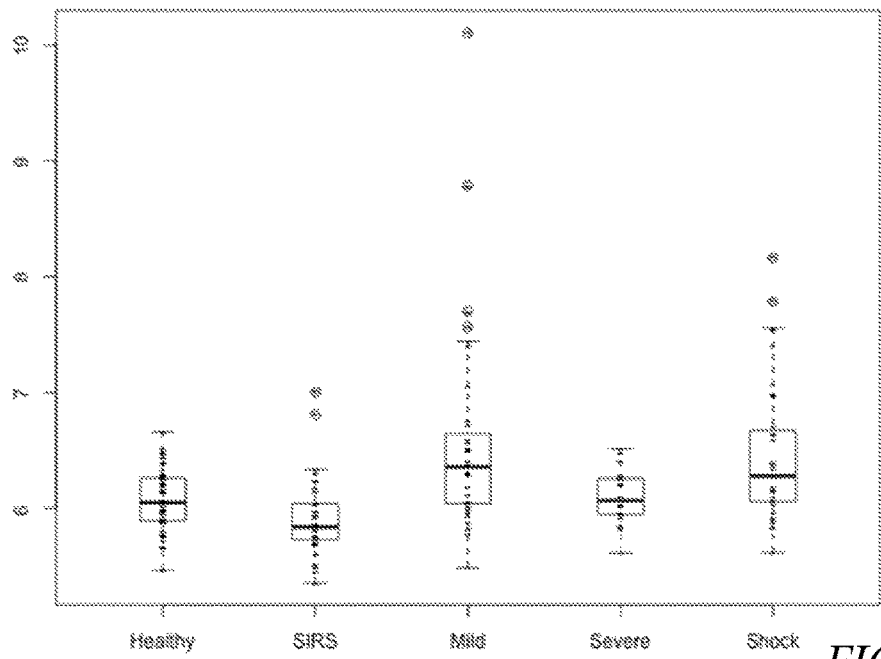

FIG. 288 shows a box and whiskers plot of CTSL1//CTSLL3 gene expression for healthy subjects and subjects with SIRS, mild sepsis, severe sepsis.

Figure 289:
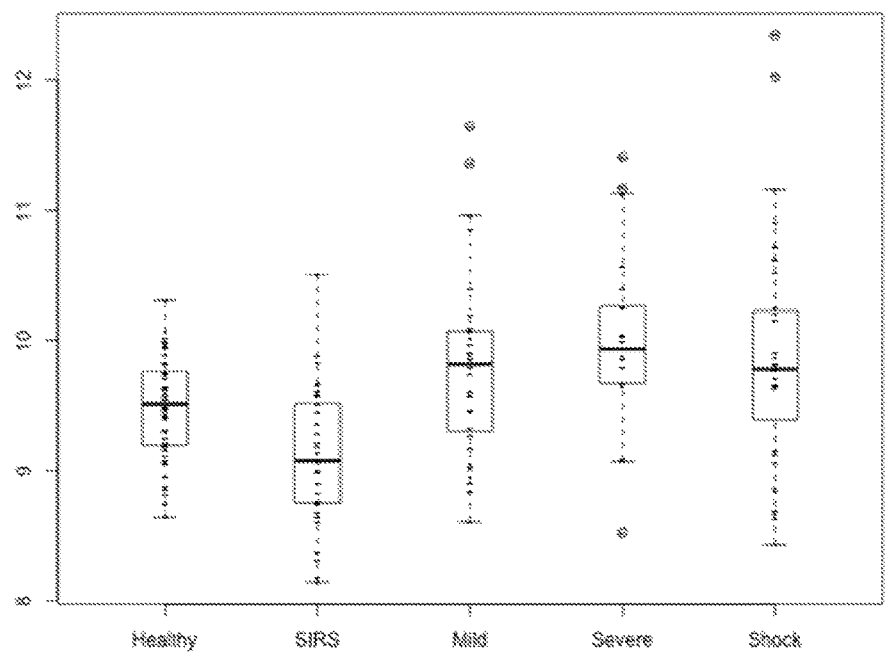

FIG. 289 shows a box and whiskers plot of NP gene expression for healthy subjects and subjects with SIRS, mild sepsis, severe sepsis.

Figure 290:
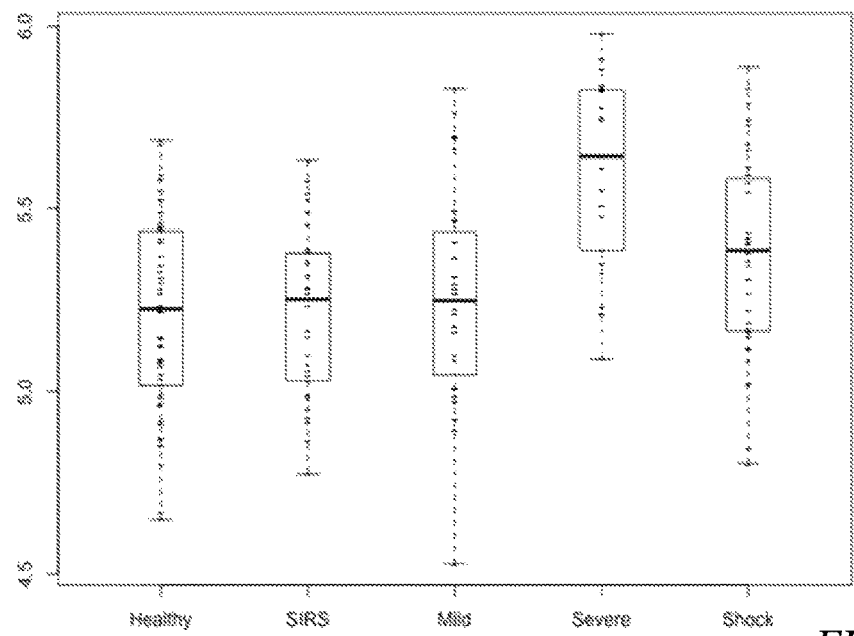

FIG. 290 shows a box and whiskers plot of ATF7 gene expression for healthy subjects and subjects with SIRS, mild sepsis, severe sepsis.

Figure 291:
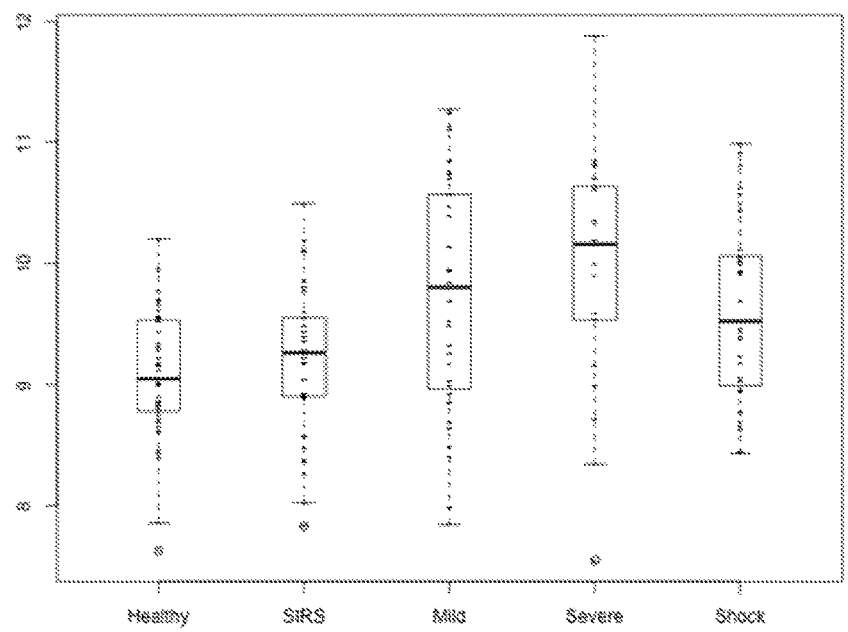

FIG. 291 shows a box and whiskers plot of SPARC gene expression for healthy subjects and subjects with SIRS, mild sepsis, severe sepsis.

Figure 292:
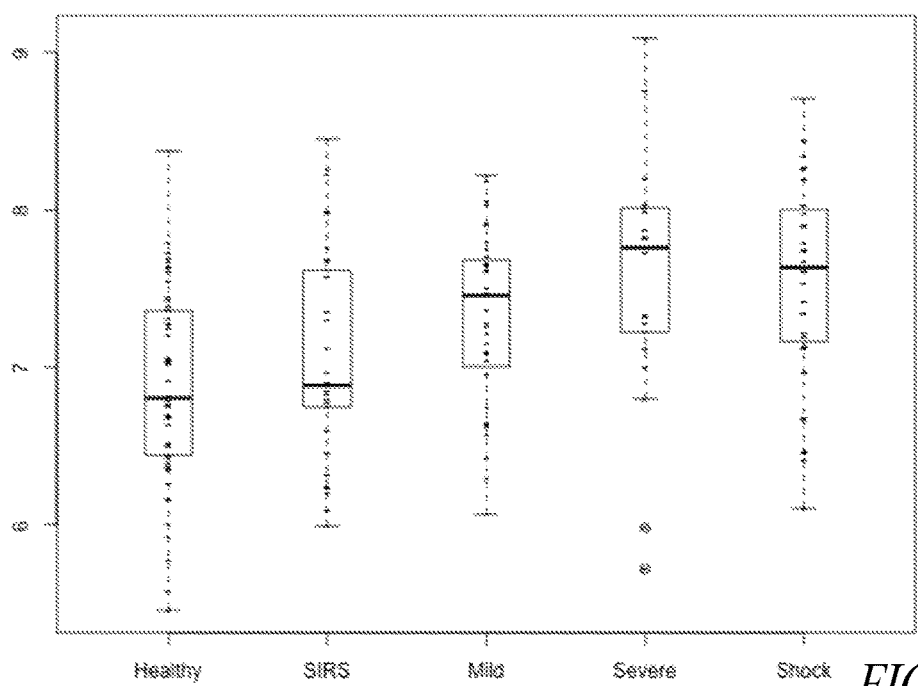

FIG. 292 shows a box and whiskers plot of PLB1 gene expression for healthy subjects and subjects with SIRS, mild sepsis, severe sepsis.

Figure 293:
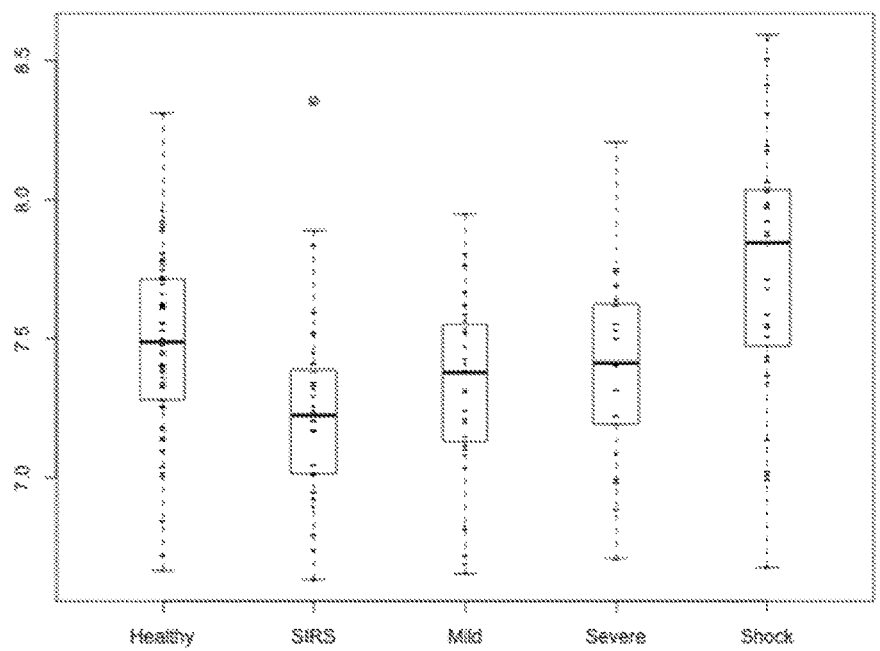

FIG. 293 shows a box and whiskers plot of C4orf3 gene expression for healthy subjects and subjects with SIRS, mild sepsis, severe sepsis.

Figure 294:
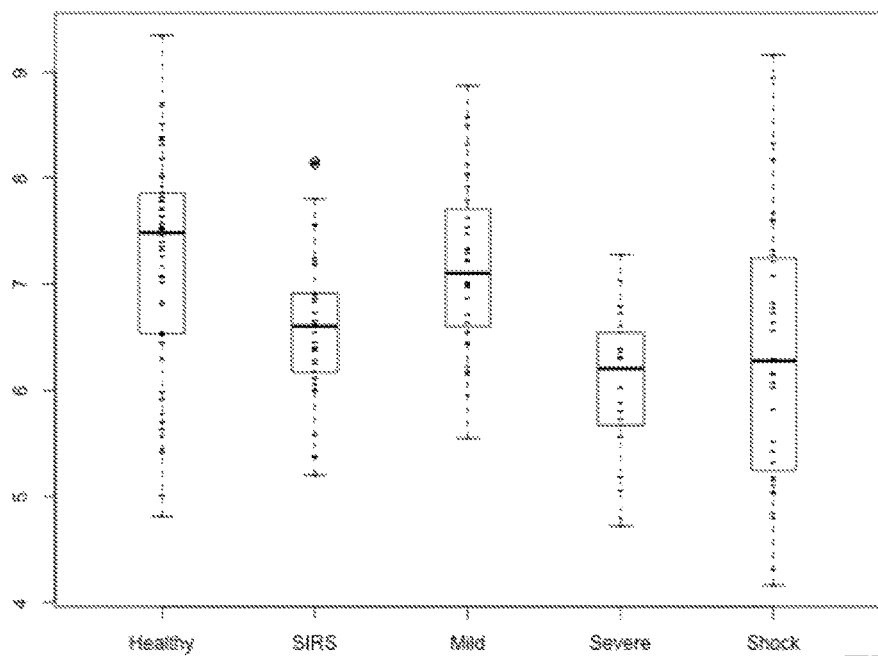

FIG. 294 shows a box and whiskers plot of POLE2 gene expression for healthy subjects and subjects with SIRS, mild sepsis, severe sepsis.

Figure 295:
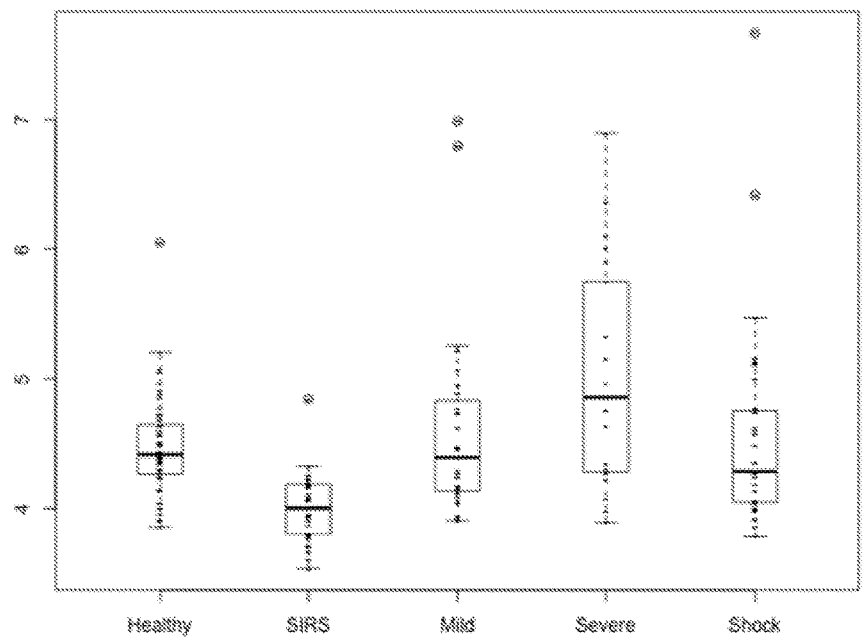

FIG. 295 shows a box and whiskers plot of TNFRSF17 gene expression for healthy subjects and subjects with SIRS, mild sepsis, severe sepsis.

Figure 296:
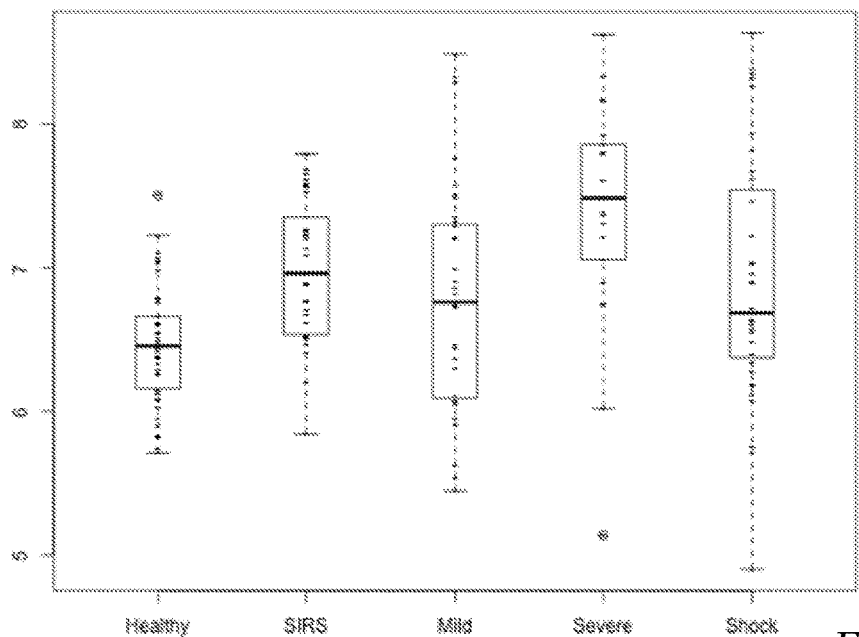

FIG. 296 shows a box and whiskers plot of FBXL13 gene expression for healthy subjects and subjects with SIRS, mild sepsis, severe sepsis.

Figure 297:
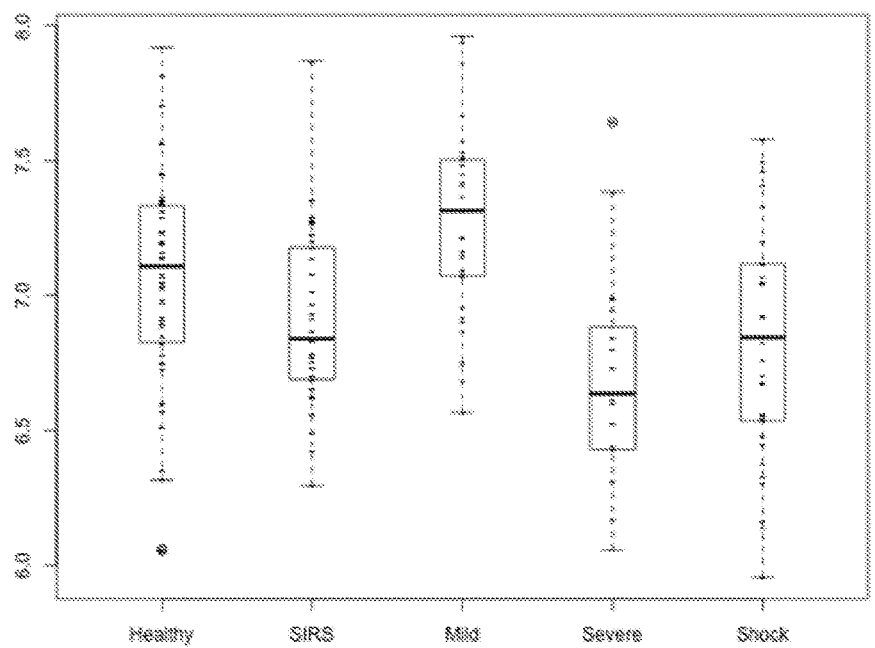

FIG. 297 shows a box and whiskers plot of PLEKHA3 gene expression for healthy subjects and subjects with SIRS, mild sepsis, severe sepsis.

Figure 298:
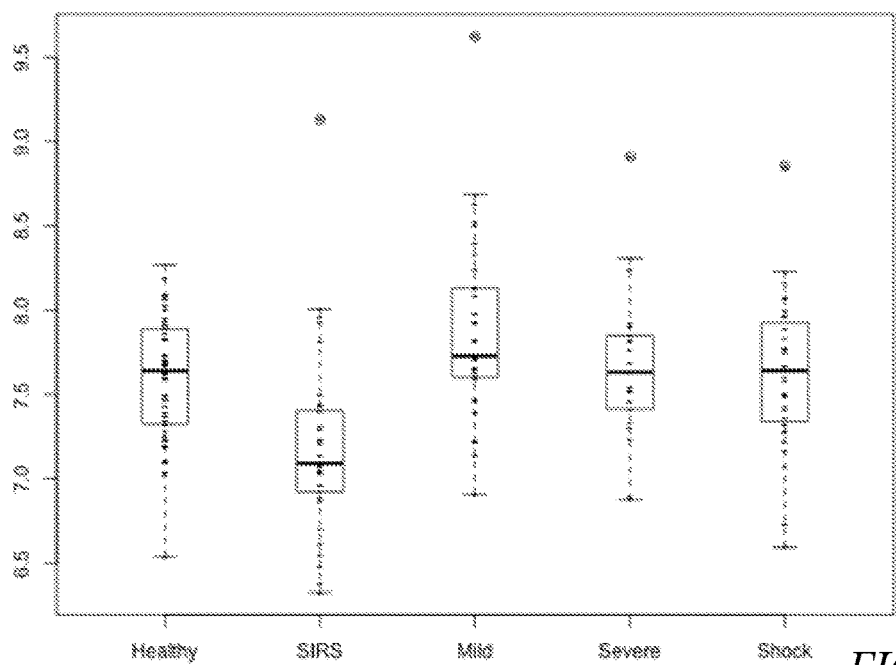

FIG. 298 shows a box and whiskers plot of TMEM62//SPCS2//LOC653566 gene expression for healthy subjects and subjects with SIRS, mild sepsis, severe sepsis.

Figure 299:
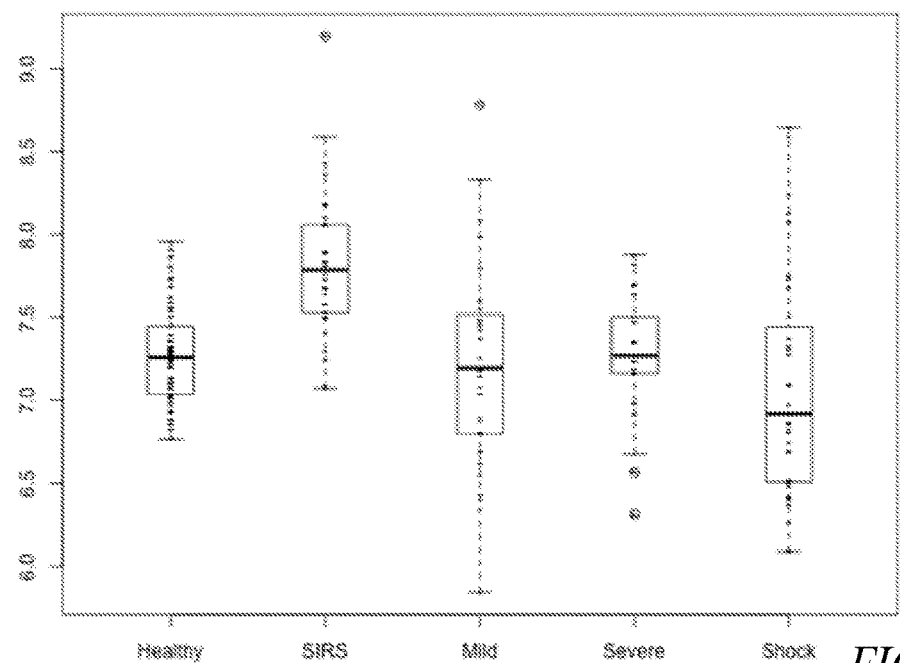

FIG. 299 shows a box and whiskers plot of RBP7 gene expression for healthy subjects and subjects with SIRS, mild sepsis, severe sepsis.

Figure 300:
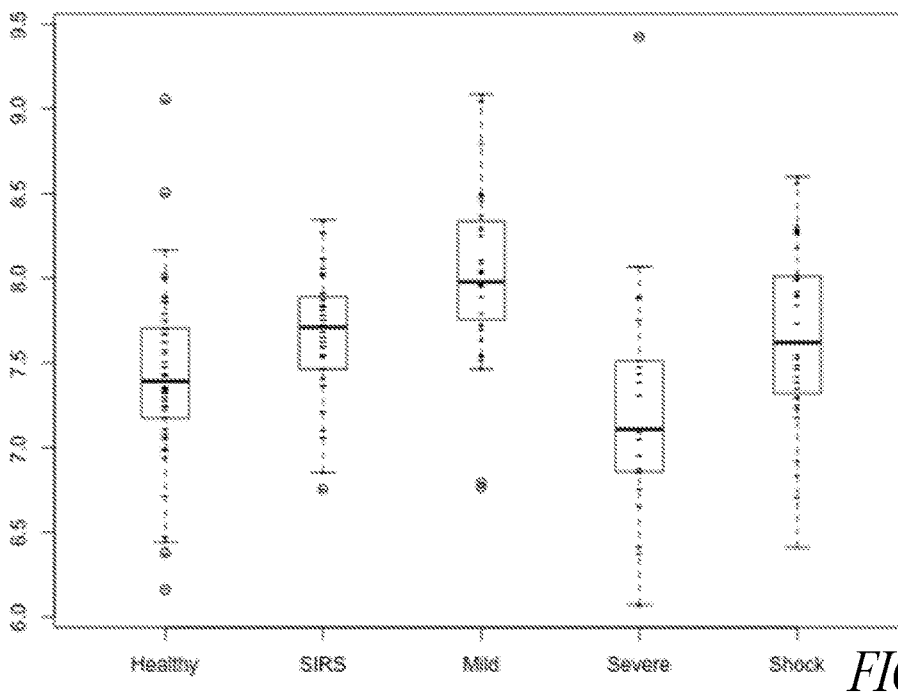

FIG. 300 shows a box and whiskers plot of PLEKHF2 gene expression for healthy subjects and subjects with SIRS, mild sepsis, severe sepsis.

Figure 301:
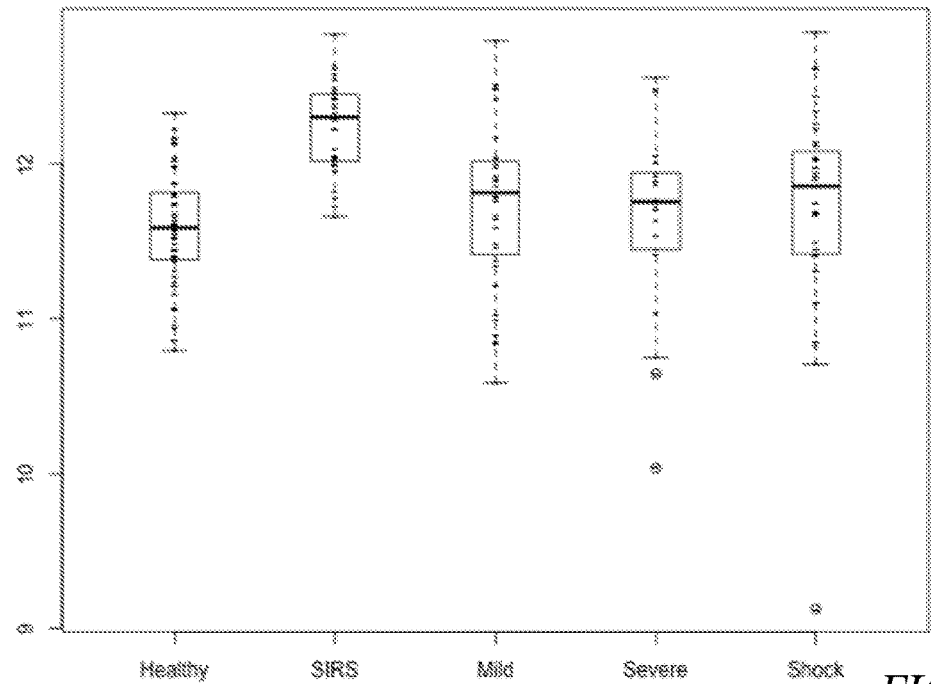

FIG. 301 shows a box and whiskers plot of RGS2 gene expression for healthy subjects and subjects with SIRS, mild sepsis, severe sepsis.

Figure 302:
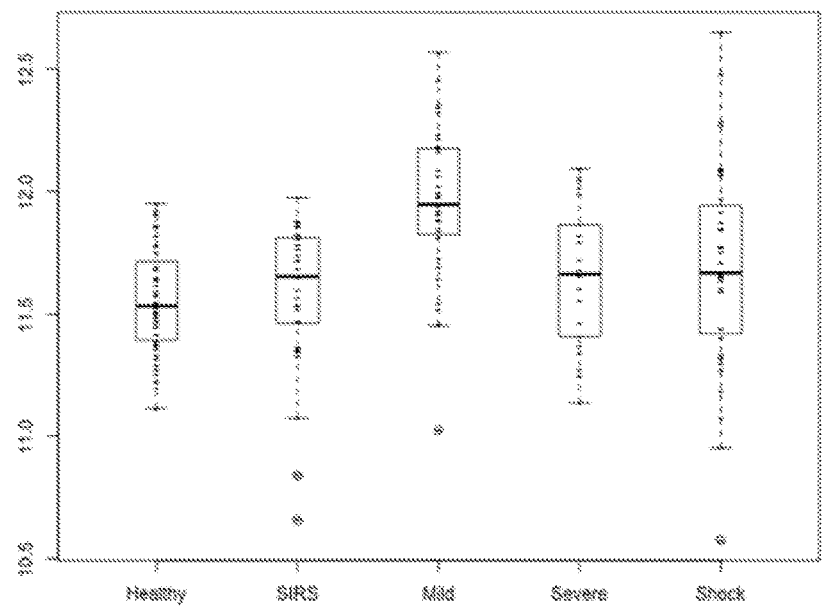

FIG. 302 shows a box and whiskers plot of ATP6V0D1//LOC100132855 gene expression for healthy subjects and subjects with SIRS, mild sepsis, severe sepsis.

Figure 303:
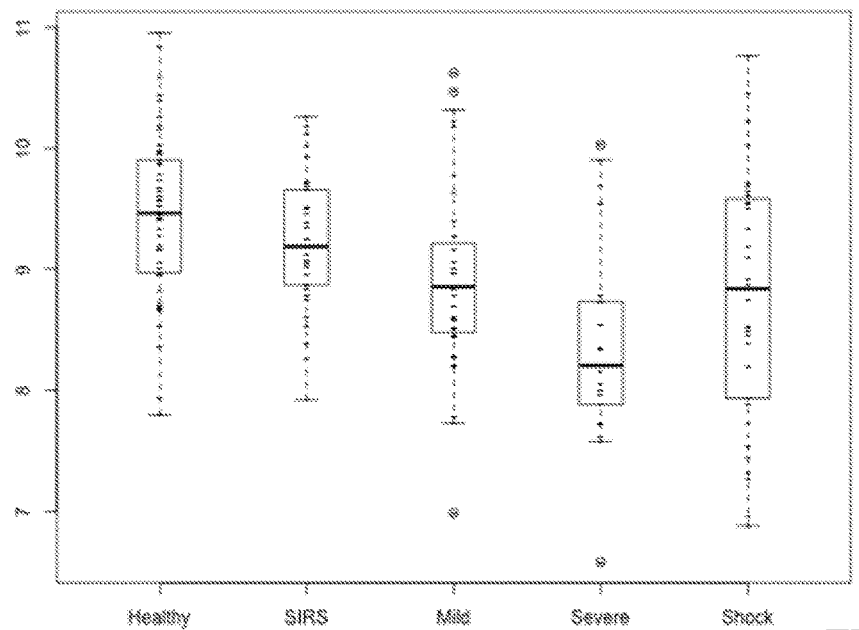

FIG. 303 shows a box and whiskers plot of RPIA gene expression for healthy subjects and subjects with SIRS, mild sepsis, severe sepsis.

Figure 304:
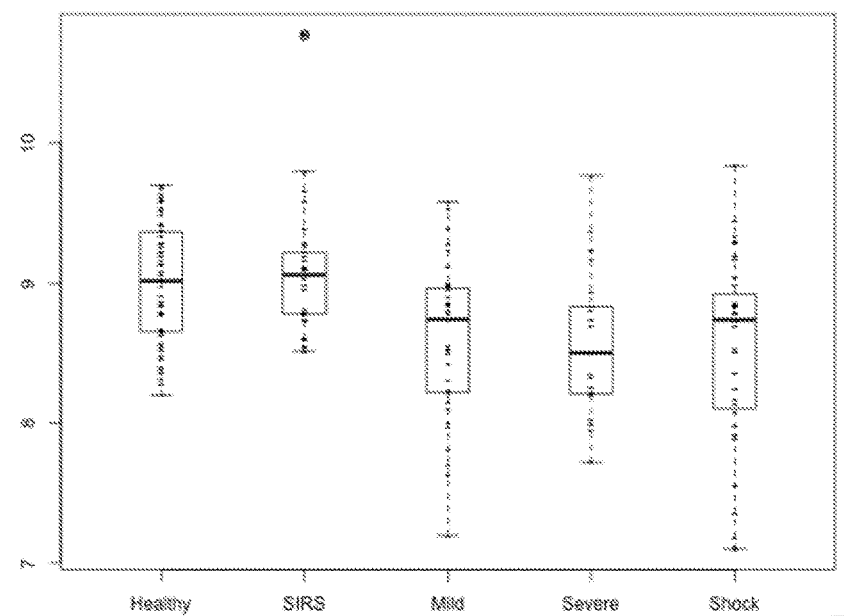

FIG. 304 shows a box and whiskers plot of CAMK1D gene expression for healthy subjects and subjects with SIRS, mild sepsis, severe sepsis.

Figure 305:
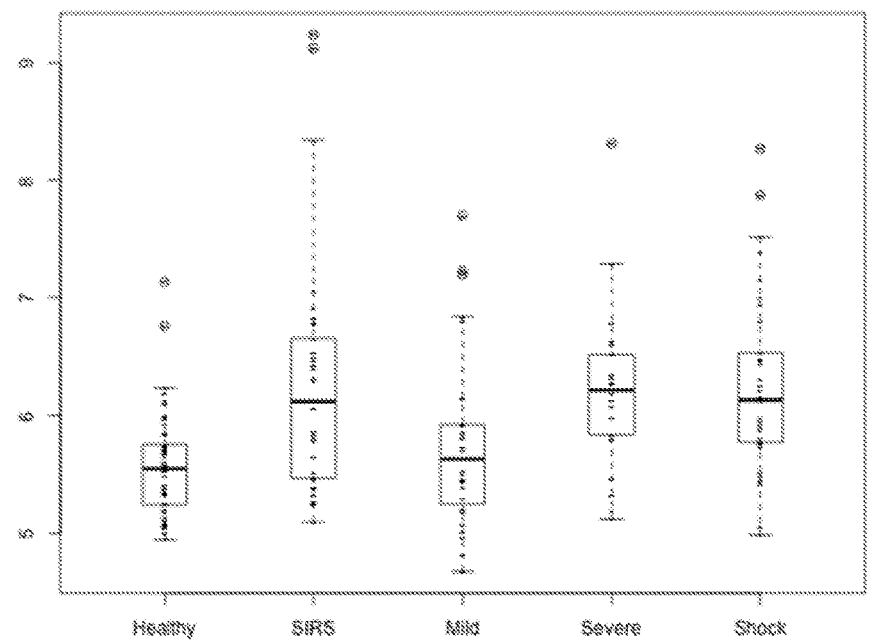

FIG. 305 shows a box and whiskers plot of IL1RL1 gene expression for healthy subjects and subjects with SIRS, mild sepsis, severe sepsis.

Figure 306:
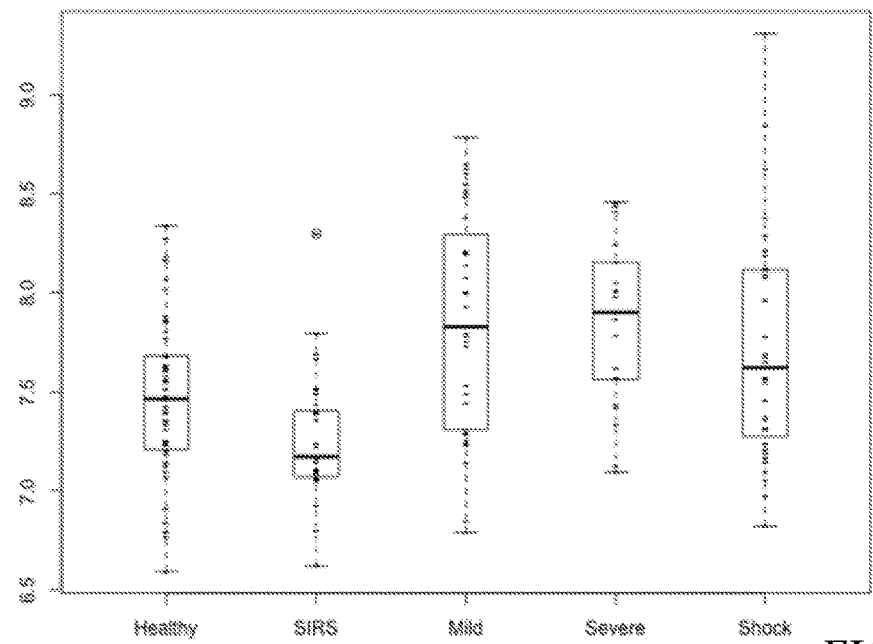

FIG. 306 shows a box and whiskers plot of CMTM5 gene expression for healthy subjects and subjects with SIRS, mild sepsis, severe sepsis.

Figure 307:

FIG. 307 shows a box and whiskers plot of AIF1 gene expression for healthy subjects and subjects with SIRS, mild sepsis, severe sepsis.

Figure 308:
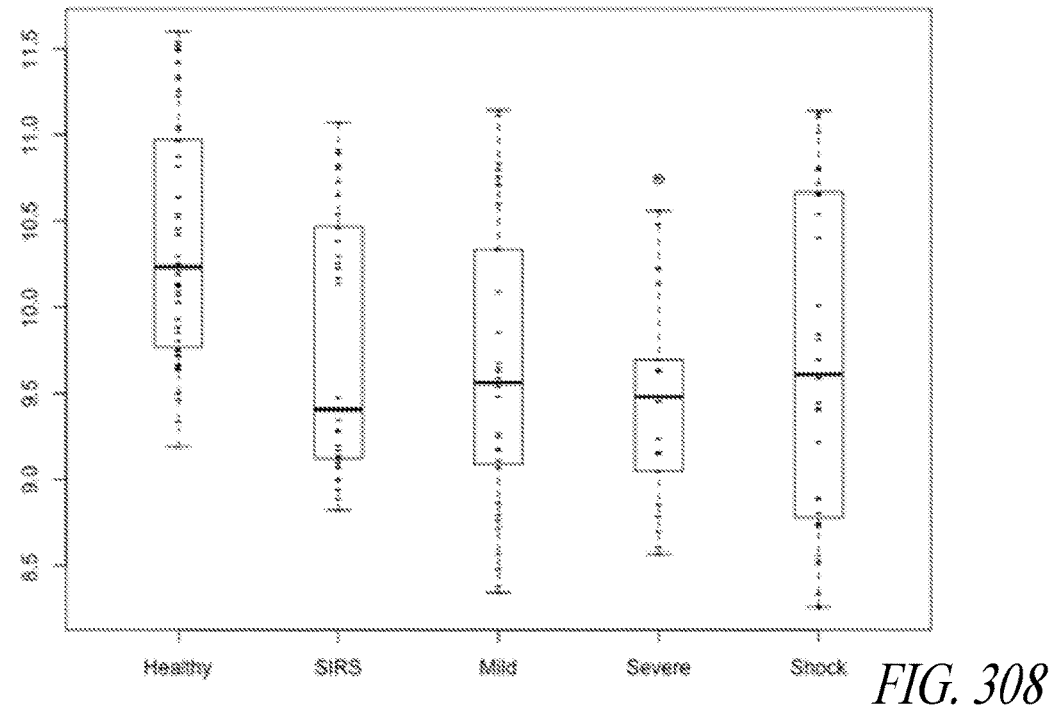

FIG. 308 shows a box and whiskers plot of CFD gene expression for healthy subjects and subjects with SIRS, mild sepsis, severe sepsis.

Figure 309:
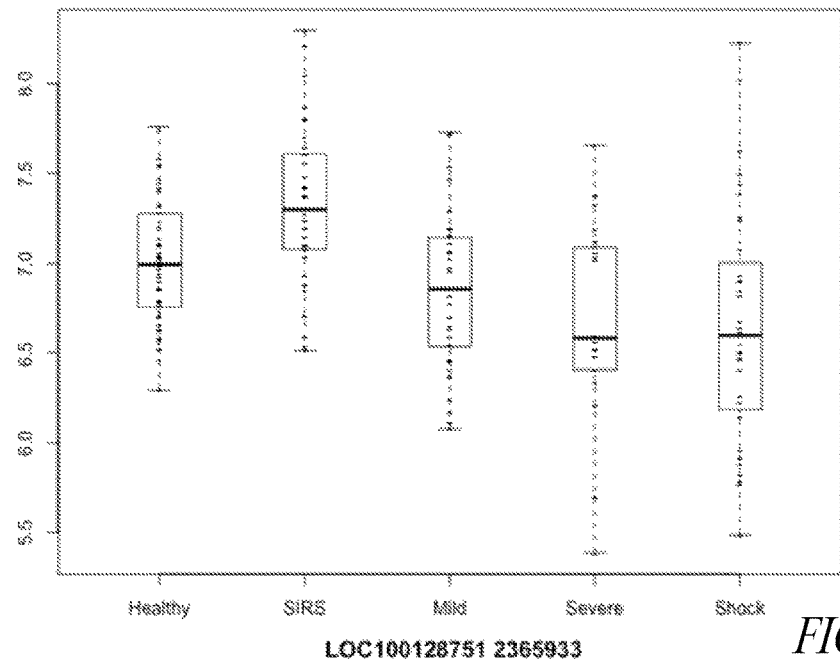

FIG. 309 shows a box and whiskers plot of MPZL2 gene expression for healthy subjects and subjects with SIRS, mild sepsis, severe sepsis.

Figure 310:
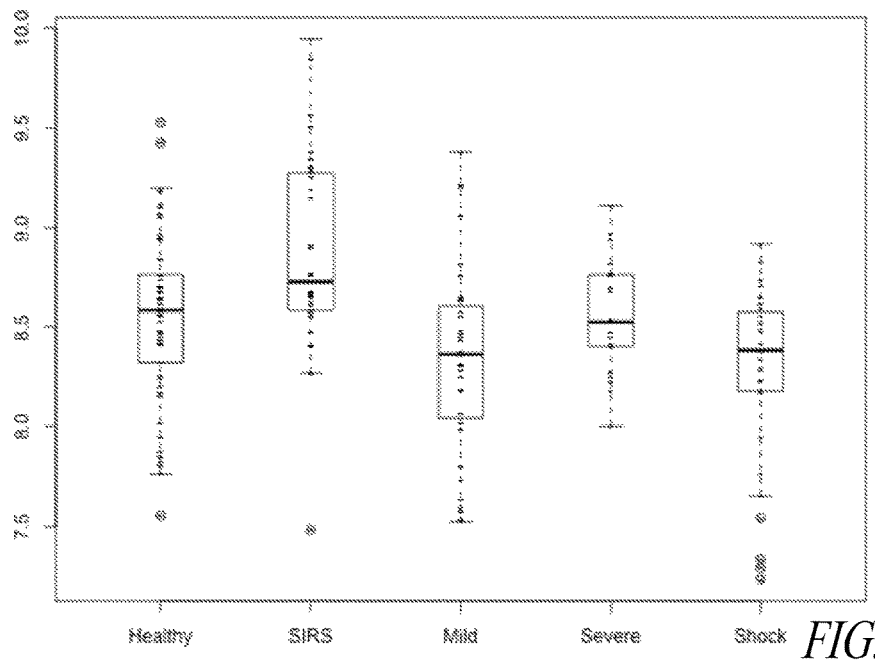

FIG. 310 shows a box and whiskers plot of LOC100128751 gene expression for healthy subjects and subjects with SIRS, mild sepsis, severe sepsis.

Figure 311:
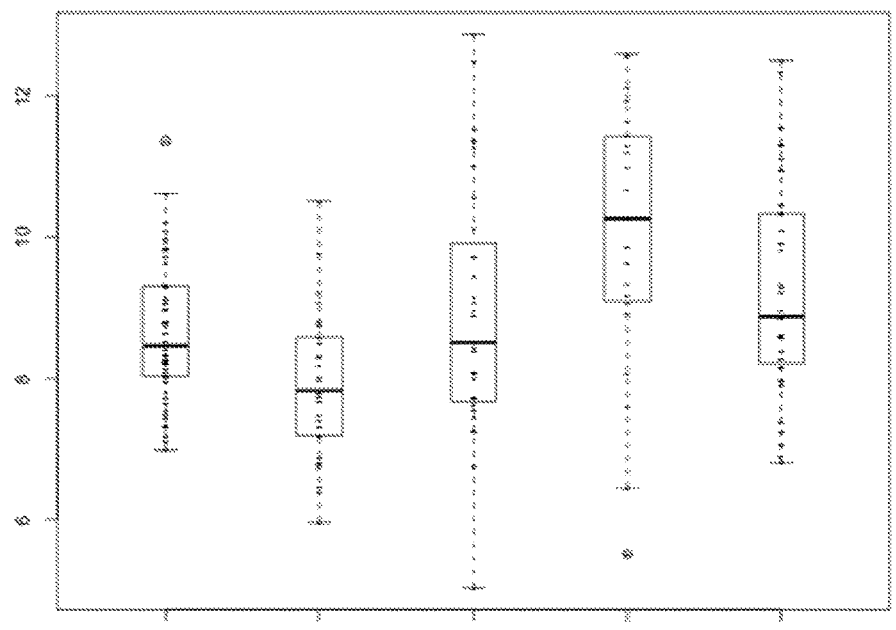

FIG. 311 shows a box and whiskers plot of IGJ gene expression for healthy subjects and subjects with SIRS, mild sepsis, severe sepsis.

Figure 312:
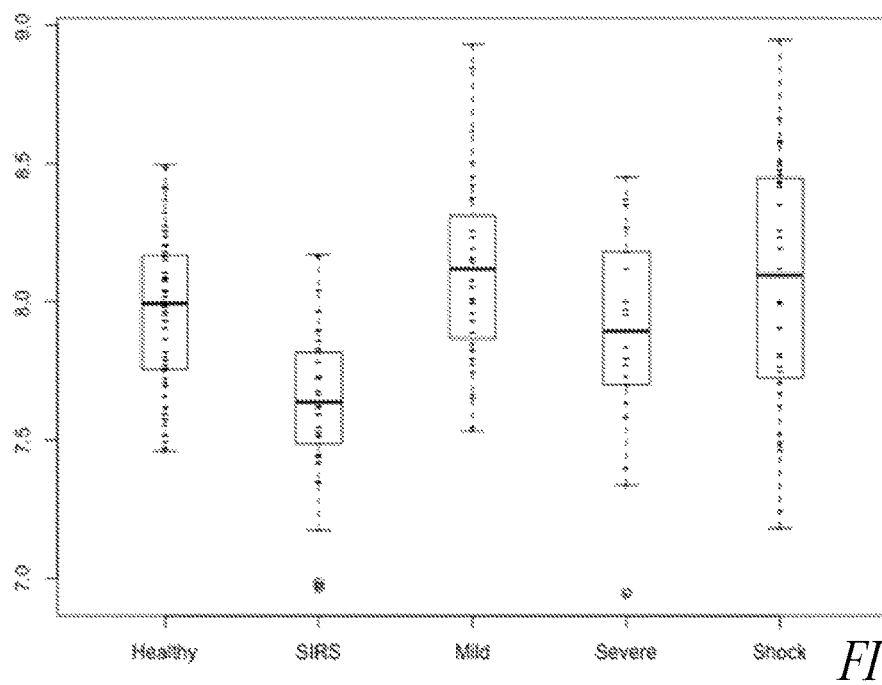

FIG. 312 shows a box and whiskers plot of CDC26 gene expression for healthy subjects and subjects with SIRS, mild sepsis, severe sepsis.

Figure 313:
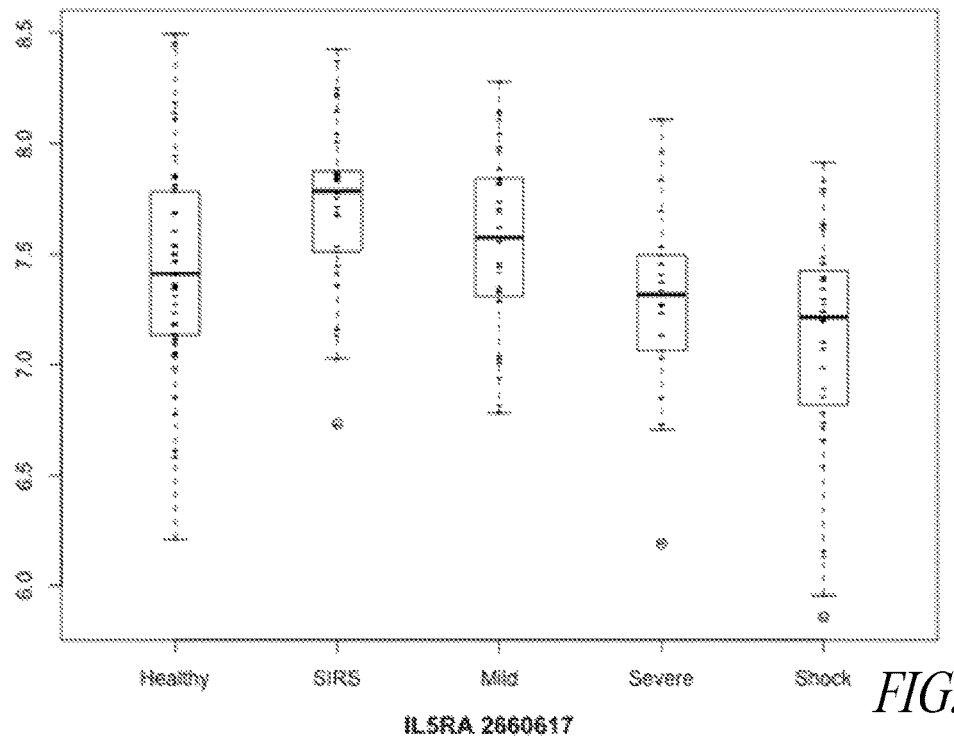

FIG. 313 shows a box and whiskers plot of PPP1R2//PPP1R2P3 gene expression for healthy subjects and subjects with SIRS, mild sepsis, severe sepsis.

Figure 314:
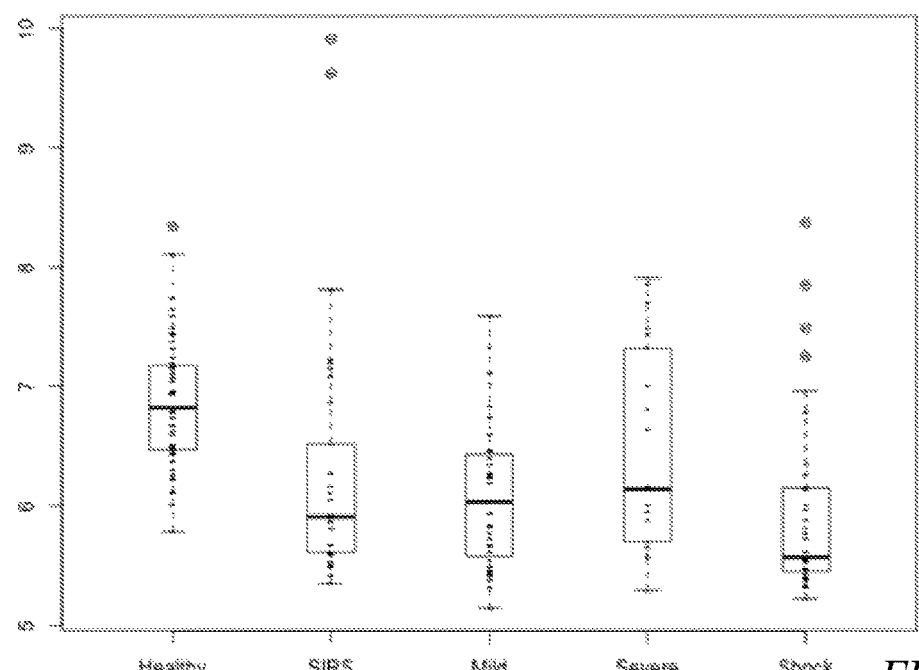

FIG. 314 shows a box and whiskers plot of IL5RA gene expression for healthy subjects and subjects with SIRS, mild sepsis, severe sepsis.

Figure 315:
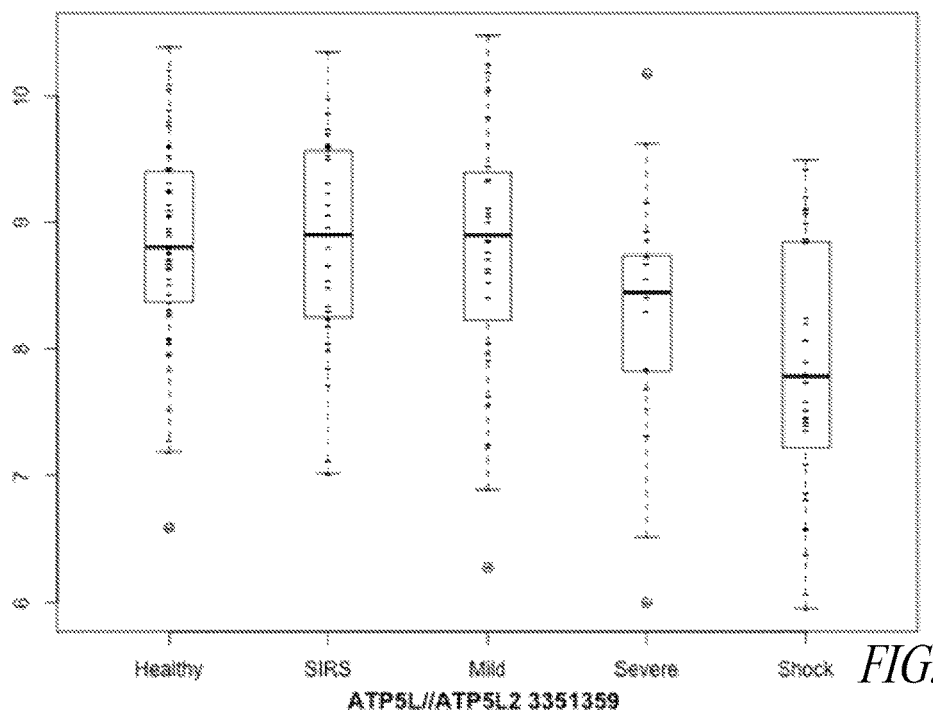

FIG. 315 shows a box and whiskers plot of ARL17P1//ARL17 gene expression for healthy subjects and subjects with SIRS, mild sepsis, severe sepsis.

Figure 316:
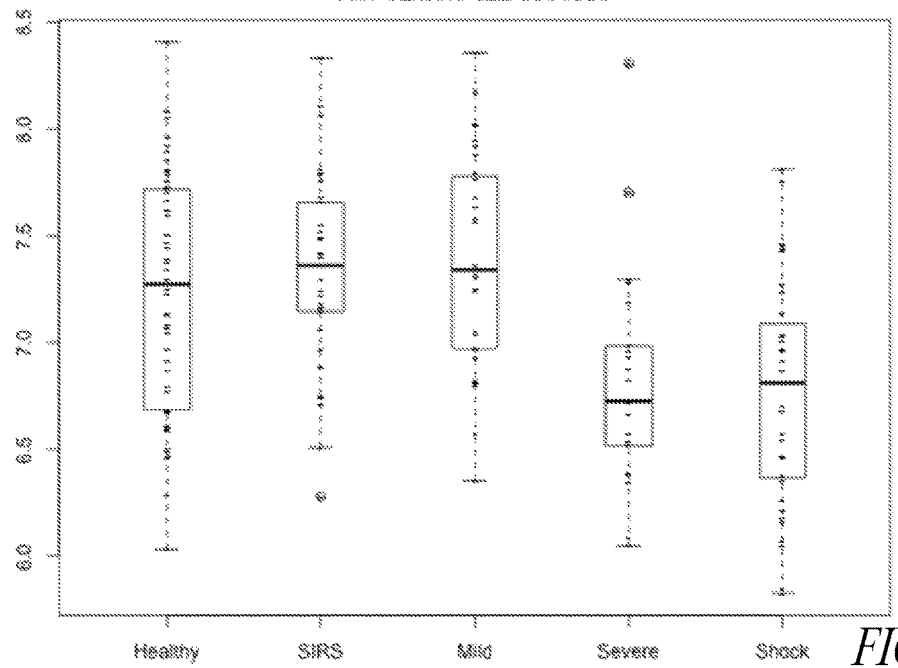

FIG. 316 shows a box and whiskers plot of ATP5L//ATP5L2 gene expression for healthy subjects and subjects with SIRS, mild sepsis, severe sepsis.

Figure 317:
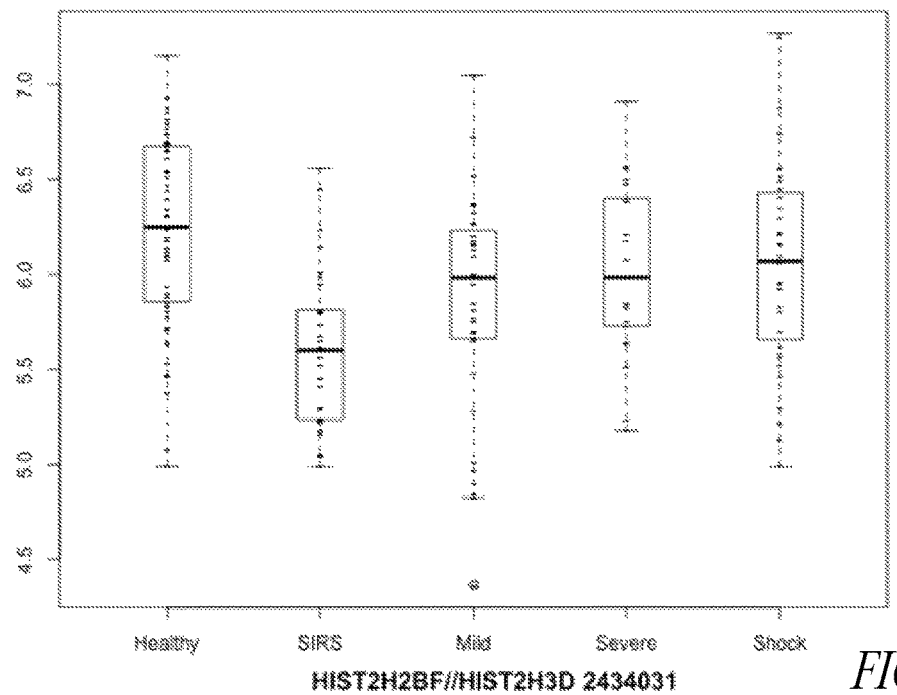

FIG. 317 shows a box and whiskers plot of TAS2R31 gene expression for healthy subjects and subjects with SIRS, mild sepsis, severe sepsis.

Figure 318:
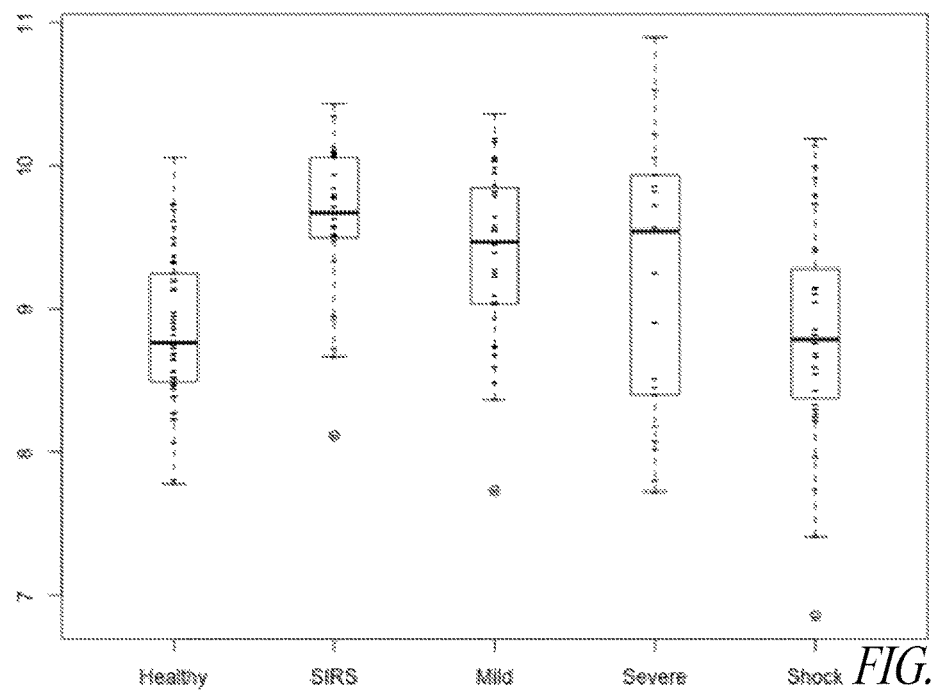

FIG. 318 shows a box and whiskers plot of HIST2H2BF//HIST2H3D gene expression for healthy subjects and subjects with SIRS, mild sepsis, severe sepsis.

Figure 319:
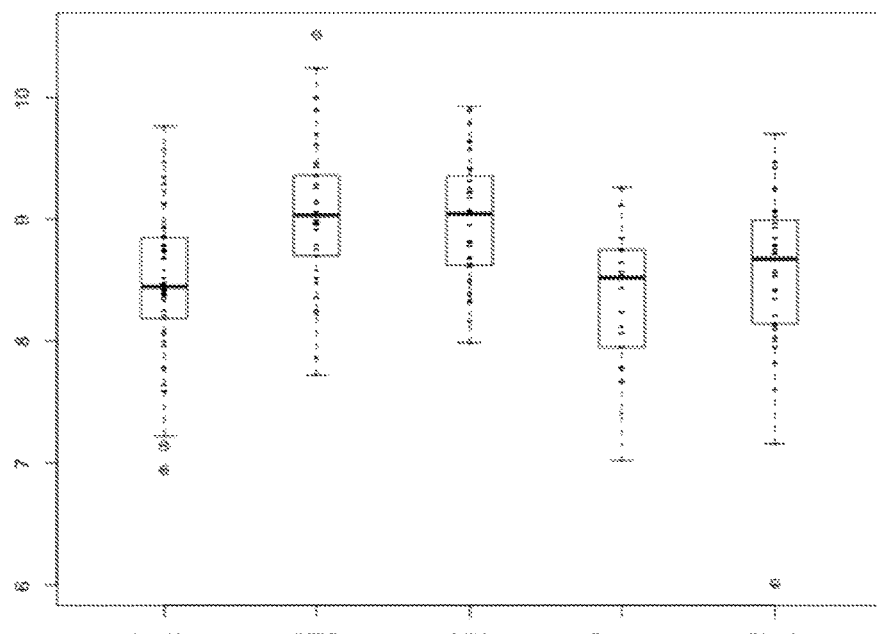

FIG. 319 shows a box and whiskers plot of CALM2//C2orf61 gene expression for healthy subjects and subjects with SIRS, mild sepsis, severe sepsis.

Figure 320:
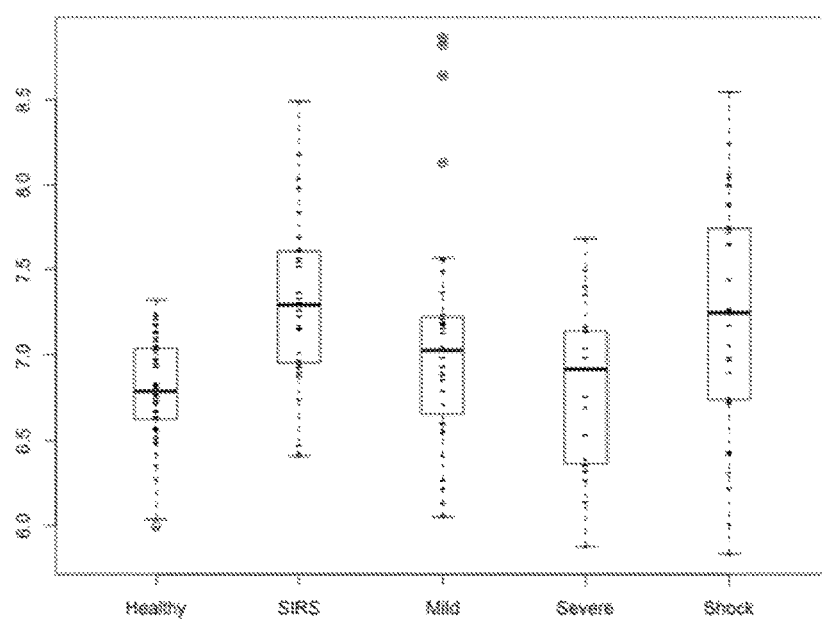

FIG. 320 shows a box and whiskers plot of SPATA6 gene expression for healthy subjects and subjects with SIRS, mild sepsis, severe sepsis.

Figure 321:
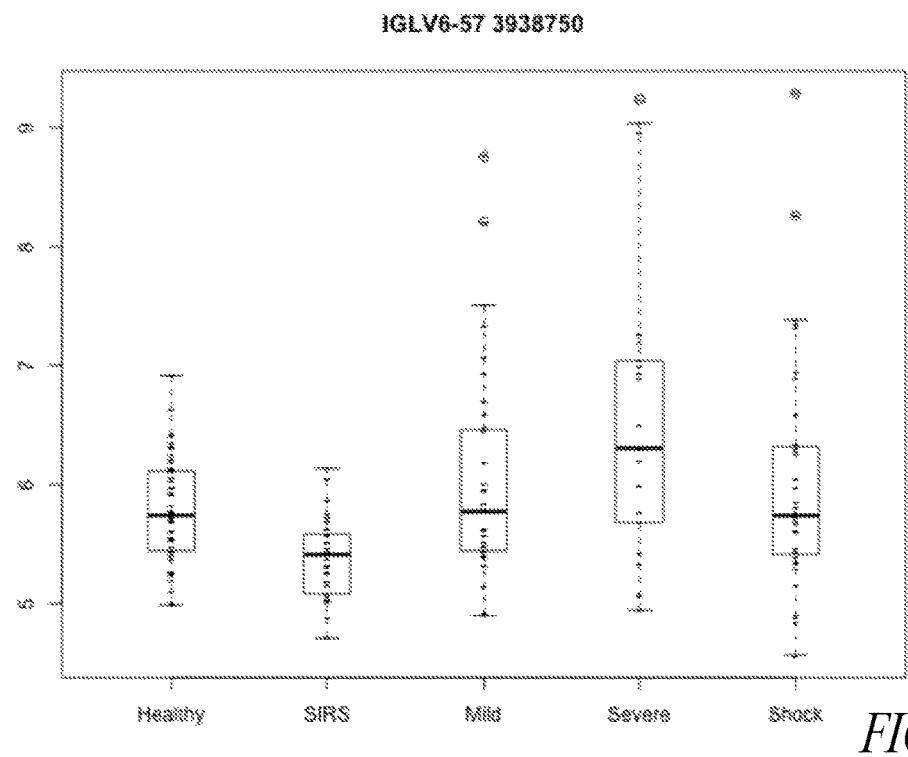

FIG. 321 shows a box and whiskers plot of IGLV6-57 gene expression for healthy subjects and subjects with SIRS, mild sepsis, severe sepsis.

Figure 322:
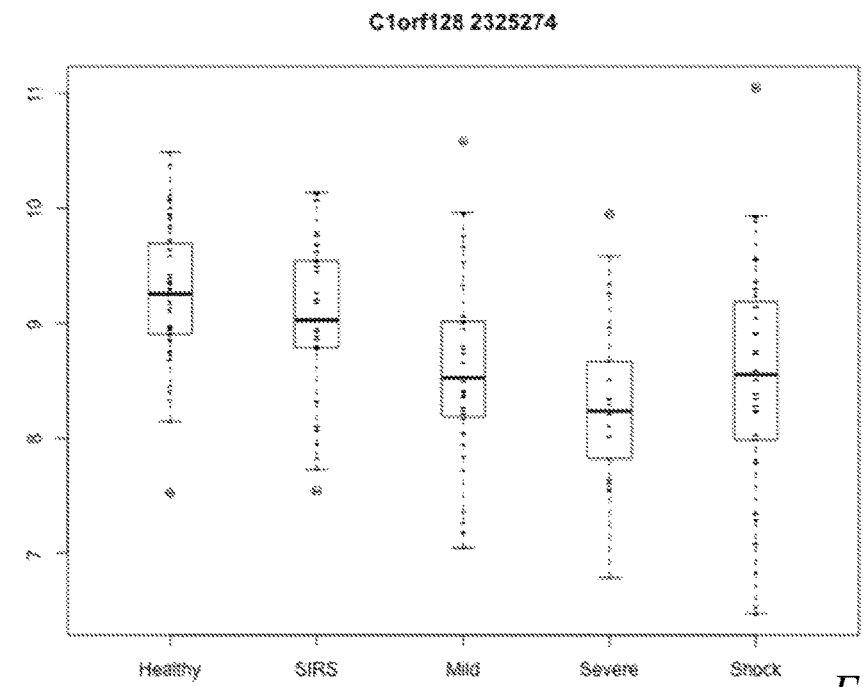

FIG. 322 shows a box and whiskers plot of C1orf128 gene expression for healthy subjects and subjects with SIRS, mild sepsis, severe sepsis.

Figure 323:
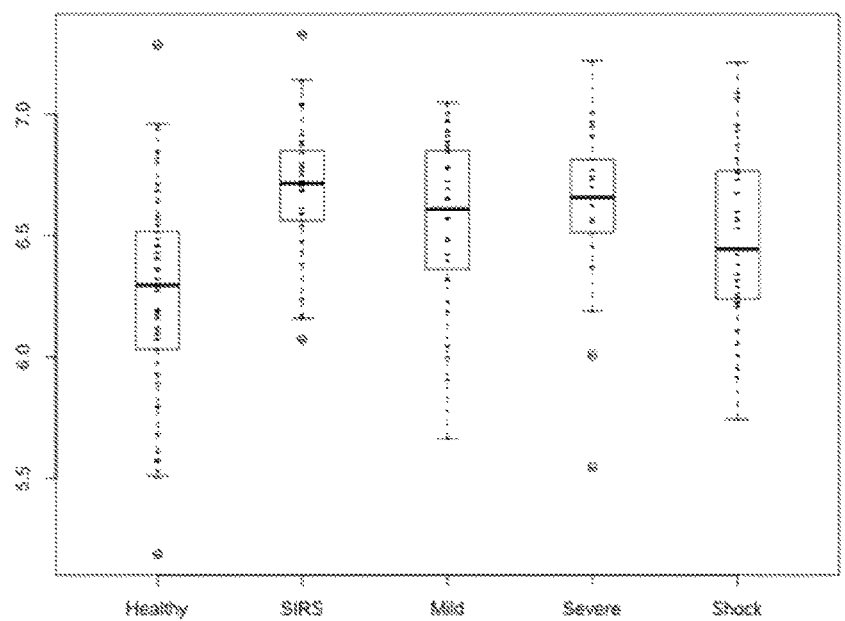

FIG. 323 shows a box and whiskers plot of KRTAP15-1 gene expression for healthy subjects and subjects with SIRS, mild sepsis, severe sepsis.

Figure 324:
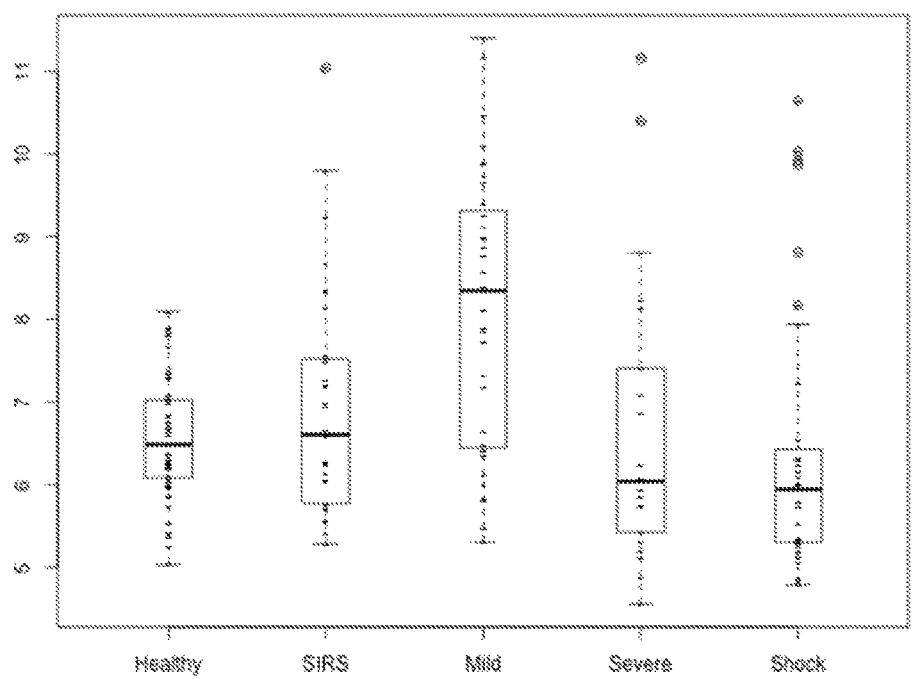

FIG. 324 shows a box and whiskers plot of IF144 gene expression for healthy subjects and subjects with SIRS, mild sepsis, severe sepsis.

Figure 325:
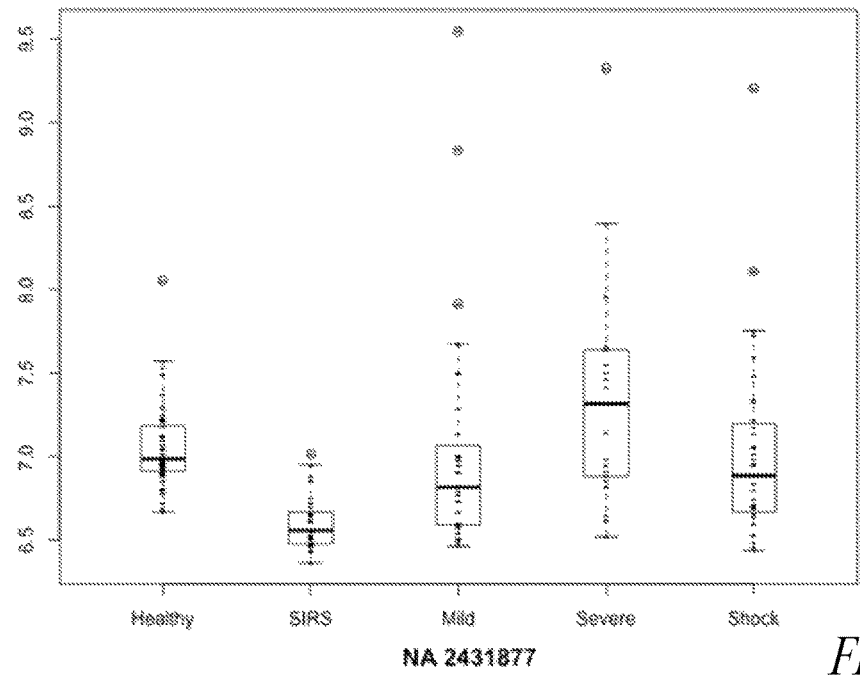

FIG. 325 shows a box and whiskers plot of IGLV3-25//IGLV3-12//IGLV1-36//IGLV3-27//IGLV7-46//IGLV4-3//IGLV3-16//IGLV3-19// gene expression for healthy subjects and subjects with SIRS, mild sepsis, severe sepsis.

Figure 326:
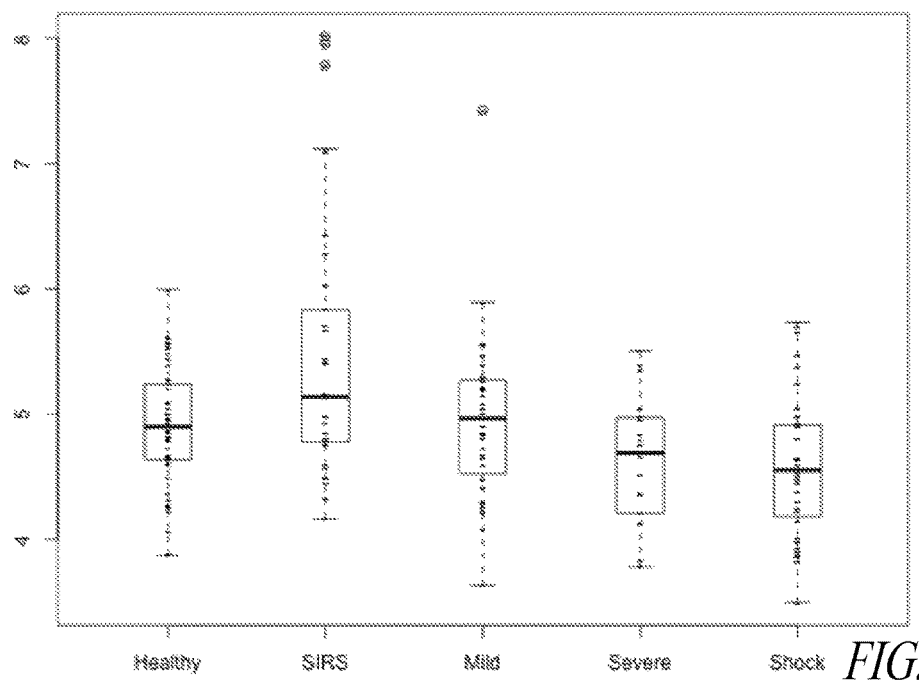

FIG. 326 shows a box and whiskers plot of NA gene expression for healthy subjects and subjects with SIRS, mild sepsis, severe sepsis.

Figure 327:
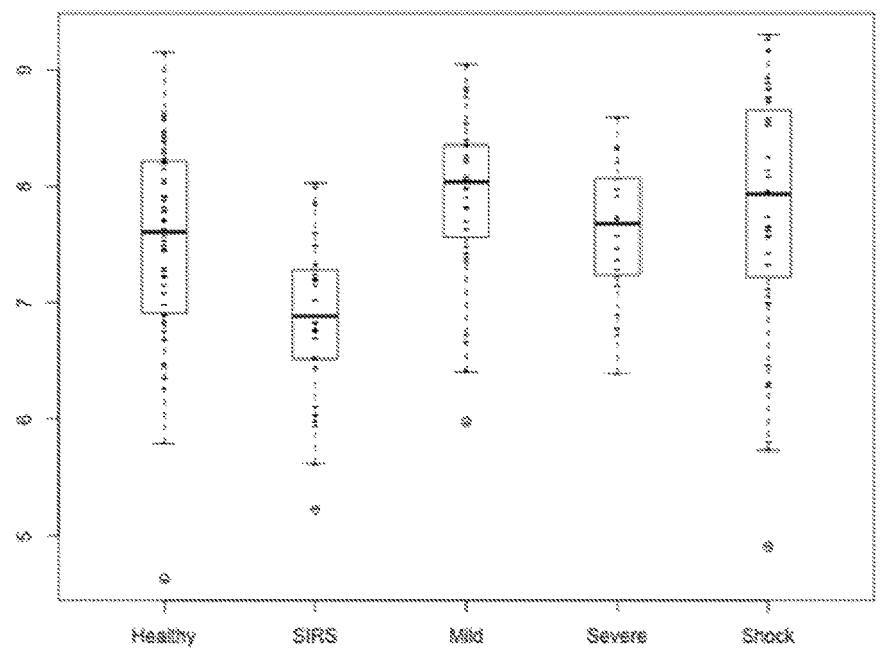

FIG. 327 shows a box and whiskers plot of SDHC gene expression for healthy subjects and subjects with SIRS, mild sepsis, severe sepsis.

Figure 328:
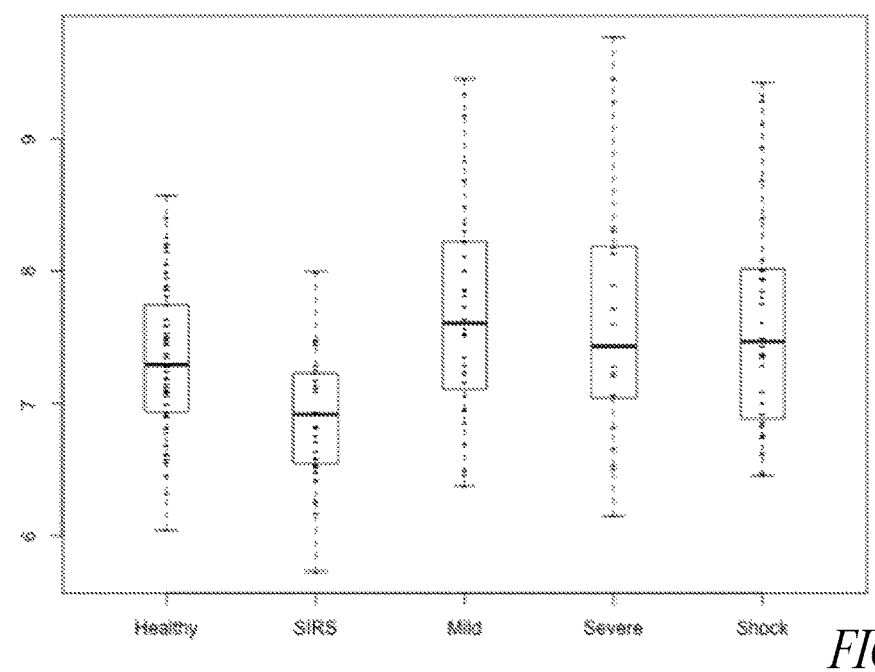

FIG. 328 shows a box and whiskers plot of NFXL1 gene expression for healthy subjects and subjects with SIRS, mild sepsis, severe sepsis.

Figure 329:
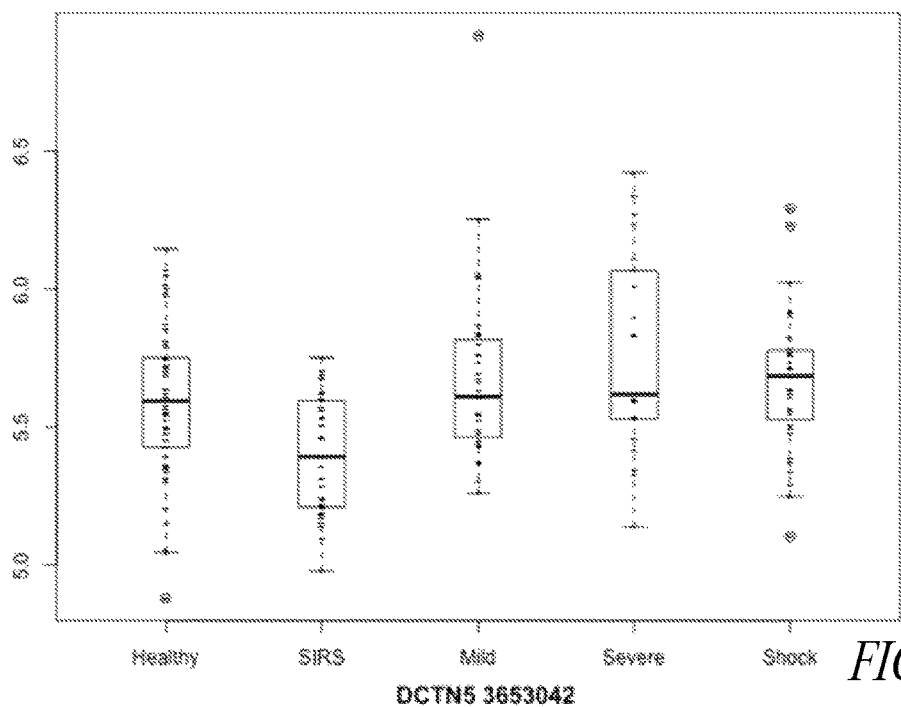

FIG. 329 shows a box and whiskers plot of GLDC gene expression for healthy subjects and subjects with SIRS, mild sepsis, severe sepsis.

Figure 330:
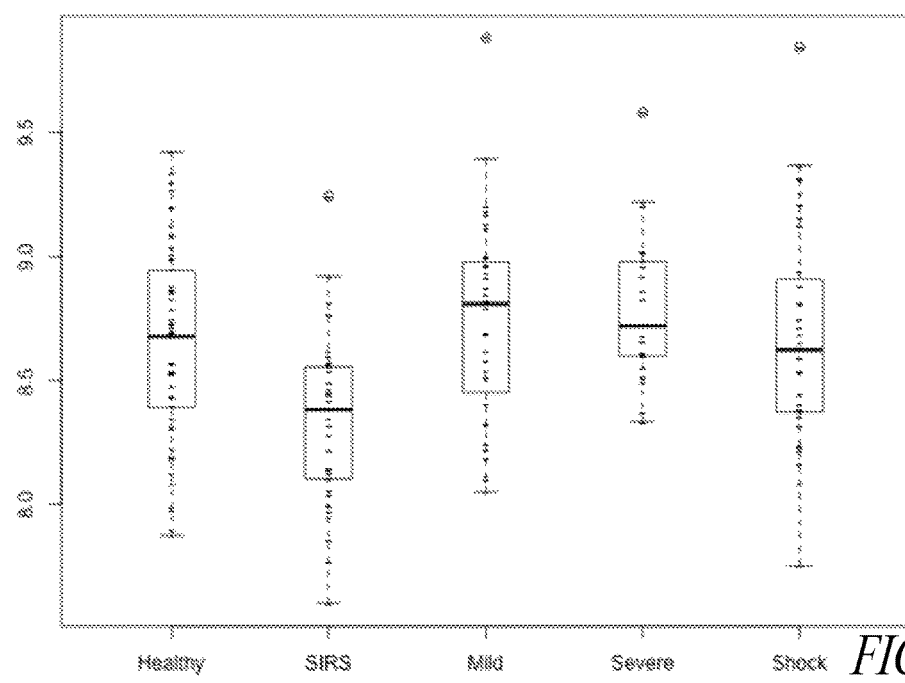

FIG. 330 shows a box and whiskers plot of DCTN5 gene expression for healthy subjects and subjects with SIRS, mild sepsis, severe sepsis.

Figure 331:
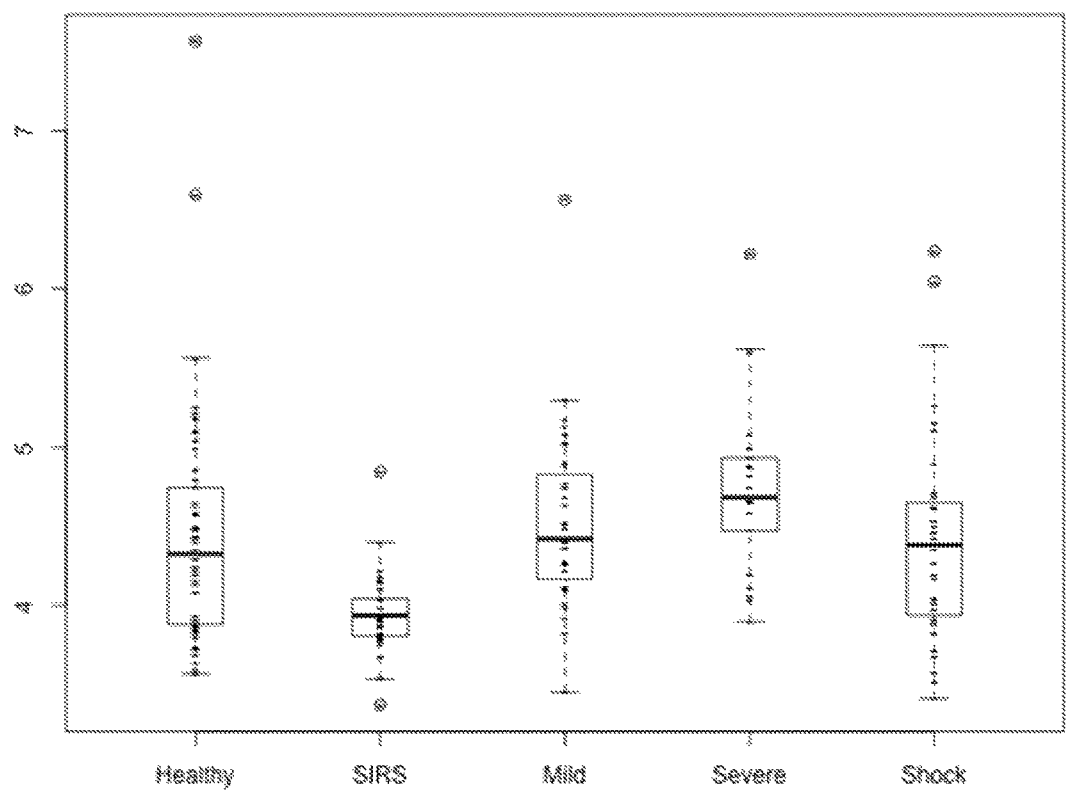

FIG. 331 shows a box and whiskers plot of KIAA0101//CSNK1G1 gene expression for healthy subjects and subjects with SIRS, mild sepsis, severe sepsis.

DETAILED DESCRIPTION OF THE PREFERRED EMBODIMENTS

An example process for performing biomarker identification will now be described. For the purpose of this example, it is assumed that the process is performed at least in part using an electronic processing device, such as a processor of a computer system, as will be described in more detail below.

Furthermore, for the purpose of explanation, different terms will be used to identify biomarkers at different stages of the process. For example, the term "reference biomarkers" is used to refer to biomarkers whose activity has been quantified for a sample population of reference individuals having different conditions, stages of different conditions, subtypes of different conditions or with different prognoses. The different reference biomarkers measured for the individuals may be referred to as a reference biomarker collection. The term "reference data" refers to data measured for the individuals in the sample population, and may include quantification of the activity of the biomarkers measured for each individual, information regarding any conditions of the individuals, and optionally any other information of interest. The number of reference biomarkers will vary, but is typically more than 1000 biomarkers.

The term "potential biomarkers" refers to a subset of the reference biomarkers that have been identified as being potentially useful in distinguishing between different groups of individuals, such as individuals suffering from different conditions, or having different stages or prognoses. The number of potential biomarkers will vary, but is typically about 200. The different potential biomarkers may be referred to as a potential biomarker collection.

The term "remaining reference biomarkers" refers to reference biomarkers remaining in the reference biomarker collection, once potential biomarkers have been removed.

The term "signature biomarkers" is used to refer to a subset of the potential biomarkers that have been identified as being potentially useful in defining signatures that can be used in performing a clinical assessment, such as to rule in or rule out a specific condition, different stages or severity of conditions, subtypes of different conditions or different prognoses. The number of signature biomarkers will vary, but is typically of the order of 10 or less, with the different signature biomarkers identified being referred to as a signature biomarker collection.

It will be appreciated that the above described terms and associated definitions are used for the purpose of explanation only and are not intended to be limiting.

In this example, at step 100, the process involves using reference data from a plurality of individuals to define a number of groups of individuals. The individuals are taken from a reference population, typically including individuals having a range of different conditions, or stages of different conditions, or subtypes of different conditions or with different prognoses.

The reference data typically includes measurements of a plurality of reference biomarkers, the measurements including information regarding the activity, such as the level or abundance, of any expression product or measurable molecule, as will be described in more detail below. The reference data may also include other additional relevant information such as clinical data regarding one or more conditions suffered by each individual. This can include information regarding a presence, absence, degree, stage, severity or progression of a condition, phenotypic information, such as details of phenotypic traits, genetic or genetically regulated information, amino acid or nucleotide related genomics information, results of other tests including imaging, biochemical and hematological assays, other physiological scores such as a SOFA (Sequential Organ Failure Assessment) score, or the like and this is not intended to be limiting, as will be apparent from the description below.

At step 110, a plurality of analysis techniques, such as statistical analysis or machine learning techniques, are used to identify a number of potential biomarkers from the plurality of reference biomarkers that are potentially useful for distinguishing the groups of individuals, allowing the potential biomarkers to be used in selecting signature biomarkers for use in generating signatures for use in clinical assessments.

The analysis techniques are typically applied in an iterative fashion, with each iteration being used to identify a subset of reference biomarkers that might prove suitable for use as potential biomarkers. In one example, as each iteration is performed, the predictive performance of the reference biomarkers in distinguishing the groups is assessed, with reference biomarkers being identified for use as potential biomarkers only in the event that they exceed a predetermined predictive performance threshold, such as at least 90%, at least 85% or more typically, at least 80%. This threshold may be implemented as accuracy in the case of classification or a measure of correlation in the case of continuous outcomes.

Once reference biomarkers are identified for use as potential biomarkers, they can be removed from the reference biomarker collection, allowing the next iteration to be performed on the remaining reference biomarkers. The number of iterations will depend on the analysis techniques and associated parameters used, and can include at least 100, at least 500, at least 1000, at least 2000 and even at least 5000.

The process uses a plurality of different analysis techniques, such as classification, regression and/or machine learning techniques, allowing a variety of potential biomarkers to be identified. This is performed as each analysis technique typically operates slightly differently and as a result will often identify different potential biomarkers, so using the plurality of different analysis techniques ensures that as many potentially useful biomarkers as possible are captured for use as potential biomarkers.

The analysis techniques may be performed until the predictive performance of the remaining reference biomarkers in the reference biomarker collection falls below the predetermined threshold and each technique has been used, or may be repeated until a predetermined number of potential biomarkers, such as at least 100, less than 500 or more typically about 200, are identified.

Following identification of potential biomarkers, at step 120, a subset of the potential biomarkers can be optionally identified for use as signature biomarkers, to allow signatures for use in specific clinical assessments to be determined. This can be achieved in any suitable manner, but in one example, this involves a further process of identifying specific groups relevant to the clinical assessment, and then performing a further regression or other similar statistical analysis to select those potential biomarkers that can be used as signature biomarkers.

Accordingly, in one example, the above described process is used to identify a subset of measured reference biomarkers that can act as potential biomarkers, before a more in depth analysis is performed to identify a subset of potential biomarkers for use as signature biomarkers that can be used in specific clinical assessments. As a result, the above process can act as a coarse filter, allowing a relatively large number of potential biomarkers to be identified that can be used in distinguishing the different groups of individuals.

By way of example, many patients suffer from a condition called Systemic Inflammatory Response Syndrome (SIRS) (M S Rangel-Frausto, D Pittet, M Costigan, T Hwang, C S Davis, and R P Wenzel, "The Natural History of the Systemic Inflammatory Response Syndrome (SIRS). a Prospective Study.," *JAMA: the Journal of the American Medical Association* 273, no. 2 (Jan. 11, 1995): 117-123.). SIRS is an overwhelming whole body reaction that may have an infectious or non-infectious aetiology, whereas sepsis is SIRS that occurs during infection, Both are defined by a number of non-specific host response parameters including changes in heart and respiratory rate, body temperature and white cell counts (Mitchell M Levy et al., "2001 SCCM/ESICM/ACCP/ATS/SIS International Sepsis Definitions Conference," *Critical Care Medicine* 31, no. 4 (April 2003): 1250-1256, doi:10.1097/01.CCM.0000050454.01978.3B.; K Reinhart, M Bauer, N C Riedemann, and C S Hartog, "New Approaches to Sepsis: Molecular Diagnostics and Biomarkers," *Clinical Microbiology Reviews* 25, no. 4 (Oct. 3, 2012): 609-634, doi:10.1128/CMR.00016-12.) To differentiate these conditions they are referred herein to as SIRS (both conditions), infection-negative SIRS (SIRS without infection, hereafter referred to as "inSIRS") and infection-positive SIRS (sepsis, SIRS with a known or suspected infection, hereafter referred to as "ipSIRS"). The causes of SIRS are multiple and varied and can include, but are not limited to, trauma, burns, pancreatitis, endotoxemia, surgery, adverse drug reactions, and infections (local and systemic). Using two patient populations of healthy individuals and individuals having SIRS, a coarse filter can be used to identify which reference biomarkers can distinguish these two groups of individuals, thereby allowing potential biomarkers to be identified. A coarse filter could also be used to identify which reference biomarkers can separate inSIRS patients from ipSIRS patients, both groups of patients having SIRS in common, but each group of patients differing in whether a clinician has determined the presence of an infection or not.

Following this, more specific and computationally intensive analyses could be performed to identify a subset of potential biomarkers for use as signature biomarkers to answer more specific clinical questions such as: for patients with ipSIRS which biomarkers can separate out those with severe sepsis or septic shock, or provide a prognosis or indication of likely progression to another stage of disease, or for patients with inSIRS which biomarkers can separate those with pancreatitis from those following surgery.

Thus, if it is desired to make clinical assessments relating to SIRS, and in particular, inSIRS and ipSIRS, a suite of biomarkers can be quantified for individuals suffering either one of these conditions, as well as healthy individuals and used as reference biomarkers. These data can be used to define first groups of individuals having one of the two conditions or both, as well as of healthy individuals. Potential biomarkers can be ascertained that may be used to distinguish these groups. For example, the first stage could be used to determine biomarkers that differentiate healthy individuals and individuals having SIRS.

Following this, signature biomarkers for specific clinical assessments within these groups, such as distinguishing inSIRS from ipSIRS (rule in and rule out ipSIRS), can be determined. In this case, second groups are defined that relate to individuals having or not having infection-positive or inSIRS, and then signature biomarkers are determined from the potential biomarkers.

It can be complex and computationally difficult to select a limited number of clinically useful and manageable biomarkers from a large data set in a single stage. Thus, using a single stage identification process, potentially useful biomarkers can be easily overlooked or omitted, so that the resulting signature biomarkers are not necessarily the best suited for use in a specific clinical assessment. A particular benefit of the described approach is that by separating the process into multiple stages, the chances of overlooking or omitting the discovery of new and clinically useful biomarkers is greatly reduced.

The multi-stage approach allows coarse filtering to be used first so as to limit the number of measured reference biomarkers to a more manageable number of potential biomarkers, so that more specific, and computationally intensive, techniques can be used to identify signature biomarkers for use in specific clinical assessments. The coarse analysis therefore allows a collection of potential biomarkers to be established that will be relevant to a range of different but related clinical assessments. A more focussed analysis can then be performed to identify specific signature biomarkers, which is less computationally intensive than attempting to do this for a greater number of biomarkers, and also helps ensure the best biomarkers for the clinical assessment are identified by excluding the noise introduced by many uninformative biomarkers which have been removed from consideration.

The above approach can therefore allow a large number of measured reference biomarkers, typically several thousand, to be used as a basis for the analysis, thereby reducing the likelihood of new and clinically relevant biomarkers being excluded from the resulting potential biomarkers, and ultimately signature biomarkers, hence improving the ability of the signatures to be clinically useful in assessments.

In one example, the process is performed at least in part using a processing system, such as a suitably programmed computer system. This can be performed on a stand-alone computer, with the microprocessor executing applications software allowing the above-described method to be performed. Alternatively, the process can be performed by one or more processing systems operating as part of a distributed architecture, an example of which will now be described.

In this example, a base station 201 is coupled via a communications network, such as the Internet 202, and/or a number of local area networks (LANs) 204, to a number of computer systems 203. It will be appreciated that the configuration of the networks 202, 204 are for the purpose of example only, and in practice the base station 201, computer systems 203 can communicate via any appropriate mechanism, such as via wired or wireless connections, including, but not limited to mobile networks, private networks, such as an 802.11 networks, the Internet, LANs, WANs, or the like, as well as via direct or point-to-point connections, such as Bluetooth, or the like.

In one example, the base station 201 includes a processing system 210 coupled to a database 211. The base station 201 is adapted to be used in analysing reference data, selecting potential biomarkers, and optionally generating signatures for use in clinical assessments. The reference data may be stored in the database 211 and may be received from the computer systems 203, or other remote devices. The base station 201 may also be adapted to assist in performing clinical assessments by comparing individual data relating to a patient or other individual and then comparing this to the signatures to allow a clinical assessment to be made. The computer systems 203 are therefore adapted to communicate with the base station 201, allowing data to be transferred there between and/or to control the operation of the base station 201.

Whilst the base station 201 is a shown as a single entity, it will be appreciated that the base station 201 can be distributed over a number of geographically separate locations, for example by using processing systems 210 and/or databases 211 that are provided as part of a cloud based environment.

However, the above-described arrangement is not essential and other suitable configurations could be used. For example, the process for identifying biomarkers, as well as any subsequent clinical assessment of individual data could be performed on a stand-alone computer system.

An example of a suitable processing system 210 includes at least one microprocessor 300, a memory 301, an input/output device 302, such as a keyboard and/or display, and an external interface 303, interconnected via a bus 304 as shown. In this example the external interface 303 can be utilised for connecting the processing system 210 to peripheral devices, such as the communications networks 202, 204, databases 211, other storage devices, or the like. Although a single external interface 303 is shown, this is for the purpose of example only, and in practice multiple interfaces using various methods (e.g., Ethernet, serial, USB, wireless or the like) may be provided.

In use, the microprocessor 300 executes instructions in the form of applications software stored in the memory 301 to allow the biomarker identification process to be performed, as well as to perform any other required processes, such as communicating with the computer systems 203. The applications software may include one or more software modules, and may be executed in a suitable execution environment, such as an operating system environment, or the like.

Accordingly, it will be appreciated that the processing system 300 may be formed from any suitable processing system, such as a suitably programmed computer system, PC, web server, network server, or the like. In one particular example, the processing system 100 is a standard processing system such as a 32-bit or 64-bit Intel Architecture based processing system, which executes software applications stored on non-volatile (e.g., hard disk) storage, although this is not essential. However, it will also be understood that the processing system could be any electronic processing device such as a microprocessor, microchip processor, logic gate configuration, firmware optionally associated with implementing logic such as an FPGA (Field Programmable Gate Array), or any other electronic device, system or arrangement.

In one example, the computer system 203 includes at least one microprocessor 400, a memory 401, an input/output device 402, such as a keyboard and/or display, and an external interface 403, interconnected via a bus 404 as shown. In this example the external interface 403 can be utilised for connecting the computer system 203 to peripheral devices, such as the communications networks 202, 204, databases 211, other storage devices, or the like. Although a single external interface 403 is shown, this is for the purpose of example only, and in practice multiple interfaces using various methods (eg. Ethernet, serial, USB, wireless or the like) may be provided.

In use, the microprocessor 400 executes instructions in the form of applications software stored in the memory 401 to allow communication with the base station 201, for example to allow data to be supplied thereto and allowing results of any clinical assessment to be displayed to an operator. The computer system 203 may also be used to allow the operation of the base station 201 to be controlled, for example to allow the biomarker identification process to be performed remotely.

Accordingly, it will be appreciated that the computer systems 203 may be formed from any suitable processing system, such as a suitably programmed PC, Internet terminal, lap-top, hand-held PC, smart phone, PDA, web server, or the like. Thus, in one example, the processing system 100 is a standard processing system such as a 32-bit or 64-bit Intel Architecture based processing system, which executes software applications stored on non-volatile (e.g., hard disk) storage, although this is not essential. However, it will also be understood that the computer systems 203 can be any electronic processing device such as a microprocessor, microchip processor, logic gate configuration, firmware optionally associated with implementing logic such as an FPGA (Field Programmable Gate Array), or any other electronic device, system or arrangement.

Examples of the biomarker identification process, and subsequent use in a clinical assessment will now be described in further detail. For the purpose of these examples, it is assumed that reference data, including the reference biomarker collection, any potential biomarkers, signature biomarkers or signatures can be stored in the database 211, and that the biomarker identification process is performed using the processing system 210 under control of one of the computer systems 203. Thus, it is assumed that the processing system 210 of the base station 201 hosts applications software for performing the biomarker identification process, with actions performed by the processing system 210 being performed by the processor 300 in accordance with instructions stored as applications software in the memory 301 and/or input commands received from a user via the I/O device 302, or commands received from the computer system 203.

It will also be assumed that the user interacts with application software executed by the processing system 210 via a GUI, or the like presented on the computer system 203. Actions performed by the computer system 203 are performed by the processor 401 in accordance with instructions stored as applications software in the memory 402 and/or input commands received from a user via the I/O device 403. The base station 201 is typically a server which communicates with the computer system 203 via a LAN, or the like, depending on the particular network infrastructure available.

However, it will be appreciated that the above-described configuration assumed for the purpose of the following examples is not essential, and numerous other configurations may be used. It will also be appreciated that the partitioning of functionality between the computer system 203, and the base station 201 may vary, depending on the particular implementation.

A second example of a process for determining biomarkers will now be described.

In this example, at step 500 reference data is acquired for a plurality of individuals with the reference data including at least data regarding a plurality of reference biomarkers, measured for each individual.

The reference data may be acquired in any appropriate manner but typically this involves obtaining gene expression product data from a plurality of individuals, selected to include individuals diagnosed with one or more conditions of interest, as well as healthy individuals. The terms "expression" or "gene expression" refer to production of RNA message or translation of RNA message into proteins or polypeptides, or both. Detection of either types of gene expression in use of any of the methods described herein is encompassed by the present invention. The conditions are typically medical, veterinary or other health status conditions and may include any illness, disease, stages of disease, disease subtypes, severities of disease, diseases of varying prognoses or the like.

In order to achieve this, gene expression product data are collected, for example by obtaining a biological sample, such as a peripheral blood sample, and then performing a quantification process, such as a nucleic acid amplification process, including PCR (Polymerase Chain Reaction) or the like, in order to assess the activity, and in particular, level or abundance of a number of reference biomarkers. Quantified values indicative of the relative activity are then stored as part of the reference data.

Example reference biomarkers will be described in more detail below but it will be appreciated that these could include expression products such as nucleic acid or proteinaceous molecules, as well as other molecules relevant in making a clinical assessment. The number of biomarkers measured for use as reference biomarkers will vary depending upon the preferred implementation, but typically include a large number such as, 1000, 5000, 10000 or above, although this is not intended to be limiting.

The individuals also typically undergo a clinical assessment allowing any conditions to be clinically identified, and with an indication of any assessment or condition forming part of the reference data. Whilst any conditions can be assessed, in one example the process is utilized specifically to identify conditions such as SIRS, including inSIRS and ipSIRS or sepsis. It will be appreciated from the following, however, that this can be applied to a range of different conditions, and reference to SIRS or sepsis is not intended to be limiting.

Additionally, the reference data may include details of one or more phenotypic traits of the individuals and/or their relatives. Phenotypic traits can include information such as the gender, ethnicity, age, or the like. Additionally, in the case of the technology being applied to individuals other than humans, this can also include information such as designation of a species, breed or the like.

Accordingly, in one example the reference data can include for each of the reference individuals an indication of the activity of a plurality of reference biomarkers, a presence, absence degree, stage, or progression of a condition, phenotypic information such as phenotypic traits, genetic information and a physiological score such as a SOFA score.

The reference data is typically collected from individuals presenting at a medical centre with clinical signs relating to relevant any conditions of interest, and may involve follow-on consultations in order to confirm clinical assessments, as well as to identify changes in biomarkers, and/or clinical signs, and/or severity of clinical signs, over a period of time. In this latter case, the reference data can include time series data indicative of the progression of a condition, and/or the activity of the reference biomarkers, so that the reference data for an individual can be used to determine if the condition of the individual is improving, worsening or static. It will also be appreciated that the reference biomarkers are preferably substantially similar for the individuals within the sample population, so that comparisons of measured activities between individuals can be made.

It will be appreciated that once collected, the reference data can be stored in the database 211 allowing this to be subsequently retrieved by the processing system 210 for subsequent analysis. The processing system 210 also typically stores an indication of an identity of each of the reference biomarkers as a reference biomarker collection.

At step 505, the processing system 210 optionally removes a validation subgroup of individuals from the reference data prior to determining the potential biomarkers. This is performed to allow the processing system 210 to determine the potential biomarkers using the reference data without the validation subgroup so that the validation subgroup can be subsequently used to validate the potential biomarkers or signatures including a number of the potential biomarkers. Thus, data from the validation subgroup is used to validate the efficacy of the potential or signature biomarkers in identifying the presence, absence, degree, stage, severity, prognosis or progression of any one or more of the conditions to ensure the potential or signature biomarkers are effective, as will be described in more detail below.

In one example, this is achieved by having the processing system 210 flag individuals within the validation subgroup or alternatively store these in either an alternative location within the database 211 or an alternative database to the reference data. The validation subgroup of individuals is typically selected randomly and may optionally be selected to include individuals having different phenotypic traits. When a validation subgroup of individuals is removed, the remaining individuals will simply be referred to as reference data for ease throughout the remaining description.

At step 510, the individuals remaining within the reference data (ie excluding the validation subgroup) are classified into groups. The groups may be defined in any appropriate manner and may be defined based on any one or more of an indication of a presence, absence, degree, stage, severity, prognosis or progression of a condition, phenotypic traits, other tests or assays, genetic information or measured activity of the reference biomarkers associated with the individuals.

For example, a first selection of groups may be to identify one or more groups of individuals suffering from SIRS, one or more groups of individuals suffering ipSIRS, one or more groups of individuals suffering inSIRS, and one or more groups of healthy individuals. Further groups may also be defined for individuals suffering from other conditions. Additionally, further subdivision may be performed based on phenotypic traits, so groups could be defined based on gender, ethnicity or the like so that a plurality of groups of individuals suffering from a condition are defined, with each group relating to a different phenotypic trait.

It will also be appreciated, however, that identification of different groups can be performed in other manners, for example on the basis of particular activities of biomarkers within the biological samples of the reference individuals, and accordingly, reference to conditions is not intended to be limiting and other information may be used as required.

The manner in which classification into groups is performed may vary depending on the preferred implementation. In one example, this can be performed automatically by the processing system 210, for example, using unsupervised methods such as Principal Components Analysis (PCA), or supervised methods such as k-means or Self Organising Map (SOM). Alternatively, this may be performed manually by an operator by allowing the operator to review reference data presented on a Graphical User Interface (GUI), and define respective groups using appropriate input commands.

Once the groups have been defined, analysis techniques are utilized in order to identify reference biomarkers that can be utilized to potentially distinguish the groups. The analysis technique typically examines the activity of the reference biomarkers for individuals within and across the groups, to identify reference biomarkers whose activities differ between and hence can distinguish groups. A range of different analysis techniques can be utilized including, for example, regression or correlation analysis techniques. Examples of the techniques used can include established methods for parametized model building such as Partial Least Squares, Random Forest or Support Vector Machines, usually coupled to a feature reduction technique for the selection of the specific subset of the biomarkers to be used in a signature.

Such techniques are known and described in a number of publications. For example, the use of Partial Least Squares is described in "Partial least squares: a versatile tool for the analysis of high-dimensional genomic data" by Boulesteix, Anne-Laure and Strimmer, Korbinian, from Briefings in Bioinformatics 2007 vol 8. no. 1, pg 32-44. Support Vector machines are described in "LIBSVM: a library for support vector machines" by Chang, C. C. and Lin, C. J. from ACM Transactions on Intelligent Systems and Technology (TIST), 2011 vol 2, no. 3, pg 27. Standard Random Forest in R language is described in "Classification and Regression by random Forest" by Liaw, A. and Wiener, M., in R news 2002, vol2, no. 3, pg 18-22.

The analysis techniques are implemented by the processing system 210, using applications software, which allows the processing system 210 to perform multiple ones of the analysis techniques in sequence. This is advantageous as the different analysis techniques typically have different biases and can therefore be used to identify different potential biomarkers that can distinguish the groups, thereby reducing the risk of clinically relevant biomarkers being overlooked.

At step 515 a next analysis technique is selected by the processing system 210, with this being implemented at step 520 to identify the best N reference biomarkers for distinguishing the groups, where the variable N is a predetermined or algorithmically derived number of biomarkers whose value may vary depending on the analysis technique used and the preferred implementation, but is typically a relatively small number compared to the overall number of biomarkers, such as less than 10, more than 1, between 2 and 8 and 5. This process typically involves a predictive model to assess the ability of activities of particular ones of the reference biomarkers to distinguish between different groups. For example this can examine the manner in which the activity of reference biomarkers differ between groups, and/or are relatively similar within a group. This can be performed iteratively for different combinations of reference biomarkers until a best N of the reference biomarkers are identified.

At step 525, the processing system 210 determines the predictive performance of the identified best N reference biomarkers, when used in the model, for in distinguishing the relevant groups. The predictive performance is typically a parameter determined as part of the combination of analysis technique and chosen embodying model, as will be appreciated by persons skilled in the art. For example, receiver operating characteristic (ROC) analysis may be used to determine optimal assay parameters to achieve a specific level of accuracy, specificity, positive predictive value, negative predictive value, and/or false discovery rate.

Optionally, a cross-validation approach may be used whereby steps 520 and 525 are repeated M times to produce a distribution of M predictive performance measures, and N×M selected reference biomarkers. It will be appreciated that there may be none, some, or complete overlap in the sets of selected reference biomarkers for the M iterations. The union (unique set) of selected reference biomarkers from all M iterations is the set U.

At step 530, the predictive performance is compared to a predetermined threshold, which is typically selected dependent upon the preferred implementation, but may be a relatively low value such as 80%. In the case of cross-validation, in which steps 520 and 525 are repeated M times, the predictive performance at step 530 is some property of the M predictive performance measurements such as the mean, median or maximum.

By example, ruling in ipSIRS might have a lower threshold than ruling out ipSIRS since the clinical risk of treating someone with inSIRS with antibiotics might be considered to be less than not treating someone with ipSIRS with antibiotics. Thus, it can be appreciated that the threshold set is influenced by a variety of factors including clinical utility, patient welfare, disease prevalence, and econometrics of test use to name a few examples.

At step 535, if it is determined that the predictive performance is above the threshold, the identified N reference biomarkers are added to a list or collection of potential biomarkers, an indication of which is typically stored in the database 211. In the case of a cross-validation approach, where the set of unique selected biomarkers (U) may be larger than the number to be selected as potential biomarkers (N), the N most frequently selected biomarkers during the M iterations are identified as the N reference biomarkers and are then removed from the reference biomarker collection before further analysis is performed. The process then returns to step 520 allowing the same analysis technique to be performed and the next N reference biomarkers identified.

It will therefore be appreciated that this is an iterative technique that allows reference biomarkers capable of distinguishing the groups to be progressively identified with the ability of an additional N reference biomarkers to act as potential biomarkers being assessed, within each iteration. This process performs a relatively coarse filtering of reference biomarkers allowing groups of reference biomarkers with predictive performance above the threshold to be progressively removed from the reference biomarker collection and added to the potential biomarker collection.

During this process, if it is determined that the predictive performance of the N identified reference biomarkers is below the threshold, then the process moves to step 540 when it is determined by the processing system 210 if all analysis techniques have been used. If not, the process returns to step 515 allowing a next analysis technique to be selected.

Thus, it will be appreciated that the iterative process is repeated for a number of different analysis techniques allowing biases between the techniques to identify different potential biomarkers. Accordingly, this process progressively identifies reference biomarkers useful as potential biomarkers utilizing a coarse identification process that can be performed relatively rapidly, and optionally in parallel, over a large number of reference biomarkers.

At this stage, the potential biomarkers may be utilized in an attempt to classify the validation subgroup of individuals. In particular, the different activities of the identified potential biomarkers for individuals within each group are utilized to attempt to classify individuals in the validation subgroup into the groups defined at step 510. In the event that classification of the validation subgroup is successful, potential biomarkers may be retained, whereas if a validation is unsuccessful potential biomarkers may optionally be removed from the potential biomarker collection.

In one example, the above-described process is performed over several thousand different reference biomarkers allowing a collection of several hundred potential biomarkers to be identified. However, the potential biomarkers may not be ideal for answering specific clinical assessment questions, such as ruling in a condition, ruling out a condition, or determining a stage of progression or likely outcome of a condition or treatment.

Accordingly, once the potential biomarkers have been identified, more refined processes are used to allow the processing system 210 to identify a number of potential biomarkers for use as signature biomarkers, in turn allowing signatures to be developed for performing specific clinical assessments.

In this regard, it will be appreciated that typically clinicians will want to perform a specific clinical assessment based on a preliminary diagnosis made using clinical signs, present in a subject presented to them. Accordingly, a clinician could potentially only need to answer the question of whether the subject has ipSIRS, or does not have ipSIRS. As the cost, speed and ability to perform a diagnostic test will typically be heavily dependent on the number of biomarkers assessed as part of the test, it is preferable to be able to identify a minimal number of biomarkers that are able to answer the specific clinical assessment of interest. To address this, the process can use more refined analysis of the potential biomarkers to identify those that are most useful in performing a particular clinical assessment, and hence can be used as signature biomarkers.

Accordingly, at step 545 a next clinical assessment is determined. This can be achieved in any manner, but usually involves having the user define the clinical assessment using appropriate input commands. As part of this, at step 550, the processing system 210 is used to identify second groups that are relevant to the clinical assessment, for example, by having the user identify criteria, such as the relevant conditions associated with each group, or the stage of progression for the individuals within the groups. This could include, for example, defining groups of individuals having ipSIRS and those not having ipSIRS, or those having mild, major, worsening or improving ipSIRS. Whilst it will be appreciated that the second groups may be the same as the first groups previously defined at step 510, more typically the second groups are more appropriately targeted based on the particular clinical assessment.

At step 555, the processing system 210 uses a second analysis technique to identify a number of the potential biomarkers that best distinguish the second groups of individuals. In particular, this will attempt to identify potential biomarkers whose level of activity for the individuals within the groups, can be used to distinguish the groups. The nature of the analysis technique will vary depending upon the preferred implementation and can include analysis techniques similar to those outlined above. Alternatively, different analysis techniques can be used such as ordinal classification, which differs from regular classification in that the known order of classes is used without assumptions as to their relative similarity to impose extra constraints in the model leading to more accurate clarification of borderline cases. Such ordinal classification is described in "Support vector ordinal regression" by Chu, W. and Keerthi, S. S., in Neural Computation 2007, vol 19, no. 3, pg 792-815.

An ordinal SVM for classification consists of the same fundamental elements of any SVM technique that would be familiar to anyone skilled in the art. Namely, the objective is to describe a number of maximally separating hyperplanes in the transformed hyperspace defined by the kernel function. An ordinal classifier differs from a regular SVM classifier in that it imposes an ordinal structure through the use of the cost function. This is implemented by adding to cost functions a component which penalizes incorrect ranks during execution, as described "Support vector ordinal regression" by Chu et al. (2007, supra).

Typically, the analysis techniques are implemented to identify a limited overall number of potential biomarkers that can be used as signature biomarkers, and may therefore use more stringent criteria than the analysis techniques used in steps 515 to 530 above. Alternatively, the analysis techniques may not be limited in the number of potential biomarkers identified, and can instead identify more or less potential biomarkers than the predetermined number N, above. Additionally, for this reason, only a single analysis technique is typically required at this stage, although this is not essential and multiple second analysis techniques could be used.

At step 560, the processing system 210 determines if the predictive performance of the identified potential biomarkers exceeds a second predetermined threshold.

Optionally, a cross-validation approach may be used whereby steps 550 and 560 are repeated M times to produce a distribution of M predictive performance measures, and N×M selected reference biomarkers. It will be appreciated that there may be none, some, or complete overlap in the sets of selected reference biomarkers for the M iterations. The union (unique set) of selected reference biomarkers from all M iterations is the set U.

Optionally, a consensus approach may be used, whereby steps 555 and 560 are repeated multiple times, and the predictive performance measure is some measure of the consensus of the iterations, such as the average value.

At step 565, if it is determined that the predictive performance is not above the second predetermined threshold, the processing system 210 modifies parameters associated with the analysis technique at step 570 and the process returns to step 555 allowing the same or alternative potential biomarkers to be assessed. This process is repeated until a successful determination occurs when a limited number of potential biomarkers are identified which provide a predictive performance above the threshold, in which case the process moves on to step 575.

It will be appreciated that as this is attempting to identify a limited number of biomarkers that provide better predictive performance, the second predetermined threshold is typically set to be higher that the first predetermined threshold used at step 530, and as a result of this, the second analysis technique may be computationally more expensive. Despite this, as the process is only being performed on the basis of the potential biomarkers and not the entire set of reference biomarkers, this can typically be performed relatively easily.

At step 575, the processing system 210 determines if the identified potential biomarkers are to be excluded. This may occur for any one of a number of reasons. For example, a limited number of say five biomarkers may be identified which are capable of providing the required clinical assessment outcome. However, it may not be possible to use some of these biomarkers for legal or technical reasons, in which case the biomarkers may be excluded. In this case, the excluded biomarkers are removed from the potential biomarker database at step 580 and the process returns to step 555 allowing the analysis to be performed.

It will be appreciated that whilst such excluded biomarkers may be removed from the reference data at an earlier point in the process, the ability to identify excluded biomarkers may be difficult. For example, performing a freedom-to-operate assessment of potential biomarkers can be an expensive process. It is therefore unfeasible to do this to the entire collection of biomarkers within the reference database or even to the entire collection of potential biomarkers. Accordingly, this assessment is only typically made once a potential biomarker has been identified at step 555 to 565 as providing a predictive performance above the threshold.

In the event that none of the potential biomarkers are excluded, the identified potential biomarkers are used as signature biomarkers, and an indication of the signature biomarkers is typically stored in a signature biomarker collection in the database 211. The measured activities from the reference individuals for the signature biomarkers can then be used to generate signatures for use in performing the clinical assessment at step 585. The signatures will typically define activities or ranges of activities of the signature biomarkers that are indicative of the presence, absence, degree, stage, or progression of a condition. This allows the signatures to be used in performing diagnostic and/or prognostic assessment of subjects.

For example, an indication of the activity of the signature biomarkers can be obtained from a sample taken from a test subject, and used to derive a signature indicative of the health status of the test subject. This can then be compared to the signatures derived from the reference data to assess the likely heath status of the subject.

Following this, at step 590 the process moves on to determine whether all clinical assessments have been addressed and if not, returns to step 545 allowing a next clinical assessment to be selected. Otherwise, the process ends at step 595.

Accordingly, it will be appreciated that the above-described methodology utilizes a staged approach in order to generate potential biomarkers and optionally, further signature biomarkers, for use in performing clinical assessments.

The process utilizes an initial coarse filtering based on a plurality of analysis techniques in order to identify a limited number of potential biomarkers. The limited number of potential biomarkers, which is typically in the region of less than 500, are selected from a larger database of biomarkers as being those most capable of distinguishing between different conditions, and/or different stages or progressions of a condition.

Following this, in a further stage, specific clinical assessments are identified with additional analysis techniques being used to select particular biomarkers from the database of potential biomarkers with the particular biomarkers being capable of being use in answering the specific clinical assessments.

A specific example of the above-described process will now be described with reference to distinguishing between inSIRS and ipSIRS.

A number of patients clinically identified as having infection negative SIRS and infection positive SIRS had peripheral blood samples taken (N=141). These samples were run on microarray. The microarray data was then normalised and quality control (QC) filtered as per the recommendation of the manufacturer to produce a list of samples with a corresponding clinical diagnosis of SIRS with or without an infection (N=141), and a list of reference biomarkers that passed QC (N=15,989).

The process of building and testing a model will now be described. In this example, 10% of the samples are randomly selected to act as the testing/validation set and are put aside. The remaining 90% of the samples are the training set, used to identify the potential biomarkers.

A feature selection algorithm coupled to a machine learning model is then applied to the training set, In this example a Recursive Feature Selection Support Vector Machine, described for example in "Recursive SVM feature selection and sample classification for mass-spectrometry and microarray data", by Xuegong Zhang, Xin Lu, Qian Shi, Xiu-qin Xu, Hon-chiu E Leung, Lyndsay N Harris, James D Iglehart, Alexander Miron, Jun S Liu and Wing H Wong from BMC Bioinformatics 2006, 7:197, was used to build a model with exactly 10 genes as the input.

Assuming no technical or biological noise and ignoring sample size considerations, these genes best describe the inherent variability between inSIRS and ipSIRS samples when using an SVM model, and therefore provide the best available separation signature.

For each sample in the testing set, the model is used to predict either inSIRS or ipSIRS. If the prediction matches the clinical record for this sample, it is declared a correct prediction. The performance of the model in this case is measured by accuracy, which can be expressed as the percentage of correct predictions for the testing set.

Optionally, the building and testing step may be repeated with a different random testing and training set. This could be performed any number of times depending on the preferred implementation, and in one example is performed 100 times. If the accuracy of the model was not significantly better than the last 2 iterations (1 way ANOVA p-value >0.95), then the selection of biomarkers was terminated.

If the accuracy remained significantly better than either of the last 2 iterations (as described above), then the 10 genes that were selected in the model (or most frequently appear if repeated runs were used) are then added to the collection of potentially useful biomarkers, and were removed from subsequent iterations.

The biomarker identification process described above and elsewhere herein has been used to identify 319 biomarker genes (hereafter referred to as "inflammatory response syndrome (IRS) biomarker genes"), which are surrogate markers that are useful for assisting in distinguishing: (1) between SIRS affected subjects (i.e., subject having inSIRS or ipSIRS) and healthy subjects or subjects not affected by SIRS; (2) between subjects with inSIRS and subjects with ipSIRS; and/or (3) between subjects with different stages of ipSIRS (e.g., sepsis, severe sepsis and septic shock). Based on this identification, the present inventors have developed various methods and kits, which take advantage of these biomarkers to determine the likelihood of the presence or absence of a condition selected from a healthy condition (e.g., a normal condition or one in which inSIRS and inSIRS are absent), SIRS generally (i.e., not distinguishing between inSIRS or ipSIRS), inSIRS or ipSIRS, or to assess the likelihood of the presence, absence or risk of development of a stage of ipSIRS (e.g., a stage of ipSIRS with a particular severity, illustrative examples of which include mild sepsis, severe sepsis and septic shock). In advantageous embodiments, the methods and kits involve monitoring the expression of IRS biomarker genes in blood cells (e.g., immune cells such as leukocytes), which may be reflected in changing patterns of RNA levels or protein production that correlate with the presence of active disease or response to disease.

As used herein, the term SIRS ("systemic inflammatory response syndrome") refers to a clinical response arising from a non-specific insult with two or more of the following measureable clinical characteristics; a body temperature greater than 38° C. or less than 36° C., a heart rate greater than 90 beats per minute, a respiratory rate greater than 20 per minute, a white blood cell count (total leukocytes) greater than 12,000 per $mm^3$ or less than 4,000 per $mm^3$, or a band neutrophil percentage greater than 10%. From an immunological perspective, it may be seen as representing a systemic response to insult (e.g., major surgery) or systemic inflammation. As used herein, "inSIRS" includes the clinical response noted above but in the absence of a systemic infectious process. By contrast, "ipSIRS" includes the clinical response noted above but in the presence of a presumed or confirmed systemic infectious process. Confirmation of infectious process can be determined using microbiological culture or isolation of the infectious agent. From an immunological perspective, ipSIRS may be seen as a systemic response to microorganisms be it local, peripheral or a systemic infection.

The terms "surrogate marker" and "biomarker" are used interchangeably herein to refer to a parameter whose measurement (e.g., level, presence or absence) provides information as to the state of a subject. In various exemplary embodiments, a plurality of biomarkers is used to assess a condition (e.g., healthy condition, SIRS, inSIRS, ipSIRS, or a particular stage of ipSIRS). Measurements of the biomarkers may be used alone or combined with other data obtained regarding a subject in order to determine the state of the subject biomarker. In some embodiments, the biomarkers are "differentially present" in a sample taken from a subject of one phenotypic status (e.g., having a specified condition) as compared with another phenotypic status (e.g., not having the condition). A biomarker may be determined to be "differentially present" in a variety of ways, for example, between different phenotypic statuses if the presence or absence or mean or median level or concentration of the biomarker in the different groups is calculated to be statistically significant. Common tests for statistical significance include, among others, t-test, ANOVA, Kruskal-Wallis, Wilcoxon, Mann-Whitney and odds ratio.

In some embodiments, the methods and kits involve: (1) correlating a reference IRS biomarker profile with the presence or absence of a condition selected from a healthy condition, SIRS, inSIRS, ipSIRS, or a particular stage of ipSIRS, wherein the reference IRS biomarker profile evaluates at least one (e.g., 1, 2, 3, 4, 5, 6, 7, 8, 9, 10 etc.) IRS biomarker; (2) obtaining an IRS biomarker profile of a sample (i.e., "a sample IRS biomarker profile") from a subject, wherein the sample IRS biomarker profile evaluates for an individual IRS biomarker in the reference IRS biomarker profile a corresponding IRS biomarker; and (3) determining a likelihood of the subject having or not having the condition based on the sample IRS biomarker profile and the reference IRS biomarker profile.

As used herein, the term "profile" includes any set of data that represents the distinctive features or characteristics associated with a condition of interest, such as with a particular prediction, diagnosis and/or prognosis of a specified condition as taught herein. The term generally encompasses quantification of one or more biomarkers inter alia nucleic acid profiles, such as for example gene expression profiles (sets of gene expression data that represents the mRNA levels of one or more genes associated with a condition of interest), as well as protein, polypeptide or peptide profiles, such as for example protein expression profiles (sets of protein expression data that represents the levels of one or more proteins associated with a condition of interest), and any combinations thereof.

Biomarker profiles may be created in a number of ways and may be the combination of measurable biomarkers or aspects of biomarkers using methods such as ratios, or other more complex association methods or algorithms (e.g., rule-based methods), as discussed for example in more detail below. A biomarker profile comprises at least two measurements, where the measurements can correspond to the same or different biomarkers. Thus, for example, distinct reference profiles may represent the prediction of a risk (e.g., an abnormally elevated risk) of having a specified condition as compared the prediction of no or normal risk of having that condition. In another example, distinct reference profiles may represent predictions of differing degrees of risk of having a specified condition.

The terms "subject," "individual" and "patient" are used interchangeably herein to refer to any subject, particularly a vertebrate subject, and even more particularly a mammalian subject. Suitable vertebrate animals that fall within the scope of the invention include, but are not restricted to, any member of the subphylum Chordata including primates, rodents (e.g., mice rats, guinea pigs), lagomorphs (e.g., rabbits, hares), bovines (e.g., cattle), ovines (e.g., sheep), caprines (e.g., goats), porcines (e.g., pigs), equines (e.g., horses), canines (e.g., dogs), felines (e.g., cats), avians (e.g., chickens, turkeys, ducks, geese, companion birds such as canaries, budgerigars etc), marine mammals (e.g., dolphins, whales), reptiles (snakes, frogs, lizards, etc.), and fish. A preferred subject is a primate (e.g., a human, ape, monkey, chimpanzee).

IRS biomarkers are suitably expression products of IRS biomarker genes, including polynucleotide and polypeptide expression products. The term "gene" as used herein refers to any and all discrete coding regions of the cell's genome, as well as associated non-coding and regulatory regions. The term "gene" is also intended to mean the open reading frame encoding specific polypeptides, introns, and adjacent 5' and 3' non-coding nucleotide sequences involved in the regulation of expression. In this regard, the gene may further comprise control signals such as promoters, enhancers, termination and/or polyadenylation signals that are naturally associated with a given gene, or heterologous control signals. The DNA sequences may be cDNA or genomic DNA or a fragment thereof. The gene may be introduced into an appropriate vector for extrachromosomal maintenance or for integration into the host.

As used herein, polynucleotide expression products of IRS biomarker genes are referred to herein as "IRS biomarker polynucleotides." Polypeptide expression products of the IRS biomarker genes are referred to herein as "IRS biomarker polypeptides."

Suitably, individual IRS biomarker genes are selected from the group consisting of: TLR5; CD177; VNN1; UBE2J1; IMP3; RNASE2//LOC643332; CLEC4D; C3AR1; GPR56; ARG1; FCGR1A//FCGR1B//FCGR1C; C11orf82; FAR2; GNLY; GALNT3; OMG; SLC37A3; BMX//HNRPDL; STOM; TDRD9; KREMEN1; FAIM3; CLEC4E; IL18R1; ACER3; ERLIN1; TGFBR1; FKBP5//LOC285847; GPR84; C7orf53; PLB1; DSE; PTGDR; CAMK4; DNAJC13; TNFAIP6; FOXD4L3//FOXD4L6//FOXD4//FOXD4L1//FOXD4L2//FOXD4L4//FOXD4L5; MMP9//LOC100128028; GSR; KLRF1; SH2D1B; ANKRD34B; SGMS2; B3GNT5//MCF2L2; GK3P//GK; PFKFB2; PICALM; METTL7B; HIST1H4C; C9orf72; HIST1H3I; SLC15A2; TLR10; ADM; CD274; CRIP1; LRRN3; HLA-DPB1; VAMP2; SMPDL3A; IFI16; JKAMP; MRPL41; SLC1A3; OLFM4; CASS4; TCN1; WSB2; CLU; ODZ1; KPNA5; PLACE; CD63; HPSE; C1orf161; DDAH2; KLRK1//KLRC4; ATP13A3; ITK; PMAIP1; LOC284757; GOT2; PDGFC; B3GAT3; HIST1H4E; HPGD; FGFBP2; LRRC70//IPO11; TMEM144//LOC285505; CDS2; BPI; ECHDC3; CCR3; HSPC159; OLAH; PPP2R5A//SNORA16B; TMTC1; EAF2//HCG11//LOC647979; RCBTB2//LOC100131993; SEC24A//SAR1B; SH3PXD2B; HMGB2; KLRD1; CHI3L1; FRMD3; SLC39A9; GIMAP7; ANAPC11; EXOSC4; gene for IL-1beta-regulated neutrophil survival protein as set forth in GenBank Accession No. AF234262; INSIG1; FOLR3//FOLR2; RUNX2; PRR13//PCBP2; HIST1H4L; LGALS1; CCR1; TPST1; HLA-DRA; CD163; FFAR2; PHOSPHO1; PPIF; MTHFS; DNAJC9//FAM149B1//RPL26; LCN2; EIF2AK2; LGALS2; SIAE; AP3B2; ABCA13; gene for transcript set forth in GenBank Accession No. AK098012; EFCAB2; HIST1H2AA; HINT1; HIST1H3J; CDA; SAP30; AGTRAP; SUCNR1; MTRR; PLA2G7; AIG1; PCOLCE2; GAB2; HS2ST1//UBA2; HIST1H3A; C22orf37; HLA-DPA1; VOPP1//LOC100128019; SLC39A8; MKI67; SLC11A1; AREG; ABCA1; DAAM2//LOC100131657; LTF; TREML1; GSTO1; PTGER2; CEACAM8; CLEC4A; PMS2CL//PMS2; REIN; PDE3B; SULF2; NEK6//LOC100129034; CENPK; TRAF3; GPR65; IRF4; MACF1; AMFR; RPL17//SNORD58B; IRS2; JUP; CD24; GALNT2; HSP90AB1//HSP90AB3P//HSP90AB2P; GLT25D1; OR9A2; HDHD1A; ACTA2; ACPL2; LRRFIP1; KCNMA1; OCR1; ITGA4//CERKL; EIF1AX//SCARNA9L//EIF1AP1; SFRS9; DPH3; ERGIC1; CD300A; NF-E4; MINPP1; TRIM21; ZNF28; NPCDR1; gene for protein FLJ21394 as set forth in GenBank Accession No. BC013935; gene for transcript set forth in GenBank Accession No. AK000992; ICAM1; TAF13; P4HA1//RPL17; C15orf54; KLHL5; HAL; DLEU2//DLEU2L; ANKRD28; LY6G5B//CSNK2B; KIAA1257//ACAD9//LOC100132731; MGST3; KIAA0746; HSPB1//HSPBL2; CCR4; TYMS; RRP12//LOC644215; CCDC125; HIST1H2BM; PDK4; ABCG1; IL1B; THBS1; ITGA2B; LHFP; LAIR1//LAIR2; HIST1H3B; ZRANB1; TIMM10; FSD1L//GARNL1; HIST1H2AJ//HIST1H2AI; PTGS1; gene for transcript set forth in GenBank Accession No. BC008667; UBE2F//C20orf194//SCLY; HIST1H3C; FAM118A; CCRL2; E2F6;

MPZL3; SRXN1; CD151; HIST1H3H; FSD1L; RFESD//SPATA9; TPX2; S100B; ZNF587//ZNF417; PYHIN1; KIAA1324; CEACAM6//CEACAM5; APOLD1; FABP2; KDM6B//TMEM88; IGK@//IGKC//IGKV1-5//IGKV3D-11//IGKV3-20//IGKV3D-15//LOC440871//LOC652493//LOC100291464//LOC652694//IGKV3-15//LOC650405//LOC100291682; MYL9; HIST1H2BJ; TAAR1; CLC; CYP4F3//CYP4F2; CEP97; SON; IRF1; SYNE2; MME; LASS4; DEFA4//DEFA8P; C7orf58; DYNLL1; gene for transcript set forth in GenBank Accession No. AY461701; MPO; CPM; TSHZ2; PLIN2; FAM118B; B4GALT3; RASA4//RASA4P//RASA4B//POLR2J4//LOC100132214; CTSL1//CTSLL3; NP; ATF7; SPARC; PLB1; C4orf3; POLE2; TNFRSF17; FBXL13; PLEKHA3; TMEM62//SPCS2//LOC653566; RBP7; PLEKHF2; RGS2; ATP6V0D1//LOC100132855; RPIA; CAMK1D; IL1RL1; CMTM5; AIF1; CFD; MPZL2; LOC100128751; IGJ; CDC26; PPP1R2//PPP1R2P3; IL5RA; ARL17P1//ARL17; ATP5L//ATP5L2; TAS2R31; HIST2H2BF//HIST2H3D; CALM2//C2orf61; SPATA6; IGLV6-57; C1orf128; KRTAP15-1; IFI44; IGL@//IGLV1-44//LOC96610//IGLV2-23//IGLC1//IGLV2-18//IGLV5-45//IGLV3-25//IGLV3-12//IGLV1-36//IGLV3-27//IGLV7-46//IGLV4-3//IGLV3-16//IGLV3-19//IGLV7-43//IGLV3-22//IGLV5-37//IGLV10-54//IGLV8-61//LOC651536; gene for transcript set forth in GenBank Accession No. BCO34024; SDHC; NFXL1; GLDC; DCTN5; and KIAA0101//CSNK1G1.

As used herein, the term "likelihood" is used as a measure of whether subjects with a particular IRS biomarker profile actually have a condition (or not) based on a given mathematical model. An increased likelihood for example may be relative or absolute and may be expressed qualitatively or quantitatively. For instance, an increased risk may be expressed as simply determining the subject's level of a given IRS biomarker and placing the test subject in an "increased risk" category, based upon previous population studies. Alternatively, a numerical expression of the test subject's increased risk may be determined based upon IRS biomarker level analysis.

As used herein, the term "probability" refers strictly to the probability of class membership for a sample as determined by a given mathematical model and is construed to be equivalent likelihood in this context.

In some embodiments, likelihood is assessed by comparing the level or abundance of individual IRS biomarkers to one or more preselected or threshold levels. Thresholds may be selected that provide an acceptable ability to predict diagnosis, prognostic risk, treatment success, etc. In illustrative examples, receiver operating characteristic (ROC) curves are calculated by plotting the value of a variable versus its relative frequency in two populations in which a first population has a first condition or risk and a second population has a second condition or risk (called arbitrarily, for example, "healthy condition" and "SIRS," "healthy condition" and "inSIRS," "healthy condition" and "ipSIRS," "inSIRS" and "ipSIRS," "mild sepsis" and "severe sepsis," "severe sepsis" and "septic shock," "mild sepsis" and "septic shock," or "low risk" and "high risk").

For any particular IRS biomarker, a distribution of IRS biomarker levels for subjects with and without a disease will likely overlap. Under such conditions, a test does not absolutely distinguish a first condition and a second condition with 100% accuracy, and the area of overlap indicates where the test cannot distinguish the first condition and the second condition. A threshold is selected, above which (or below which, depending on how an IRS biomarker changes with a specified condition or prognosis) the test is considered to be "positive" and below which the test is considered to be "negative." The area under the ROC curve (AUC) provides the C-statistic, which is a measure of the probability that the perceived measurement will allow correct identification of a condition (see, e.g., Hanley et al., Radiology 143: 29-36 (1982).

Alternatively, or in addition, thresholds may be established by obtaining an earlier biomarker result from the same patient, to which later results may be compared. In these embodiments, the individual in effect acts as their own "control group." In biomarkers that increase with condition severity or prognostic risk, an increase over time in the same patient can indicate a worsening of the condition or a failure of a treatment regimen, while a decrease over time can indicate remission of the condition or success of a treatment regimen.

In some embodiments, a positive likelihood ratio, negative likelihood ratio, odds ratio, and/or AUC or receiver operating characteristic (ROC) values are used as a measure of a method's ability to predict risk or to diagnose a disease or condition. As used herein, the term "likelihood ratio" is the probability that a given test result would be observed in a subject with a condition of interest divided by the probability that that same result would be observed in a patient without the condition of interest. Thus, a positive likelihood ratio is the probability of a positive result observed in subjects with the specified condition divided by the probability of a positive results in subjects without the specified condition. A negative likelihood ratio is the probability of a negative result in subjects without the specified condition divided by the probability of a negative result in subjects with specified condition. The term "odds ratio," as used herein, refers to the ratio of the odds of an event occurring in one group (e.g., a healthy condition group) to the odds of it occurring in another group (e.g., a SIRS group, an inSIRS group, an ipSIRS group, or a group with particular stage of ipSIRS), or to a data-based estimate of that ratio. The term "area under the curve" or "AUC" refers to the area under the curve of a receiver operating characteristic (ROC) curve, both of which are well known in the art. AUC measures are useful for comparing the accuracy of a classifier across the complete data range. Classifiers with a greater AUC have a greater capacity to classify unknowns correctly between two groups of interest (e.g., a healthy condition IRS biomarker profile and a SIRS, inSIRS, ipSIRS, or ipSIRS stage IRS biomarker profile). ROC curves are useful for plotting the performance of a particular feature (e.g., any of the IRS biomarkers described herein and/or any item of additional biomedical information) in distinguishing or discriminating between two populations (e.g., cases having a condition and controls without the condition). Typically, the feature data across the entire population (e.g., the cases and controls) are sorted in ascending order based on the value of a single feature. Then, for each value for that feature, the true positive and false positive rates for the data are calculated. The sensitivity is determined by counting the number of cases above the value for that feature and then dividing by the total number of cases. The specificity is determined by counting the number of controls below the value for that feature and then dividing by the total number of controls. Although this definition refers to scenarios in which a feature is elevated in cases compared to controls, this definition also applies to scenarios in which a feature is lower in cases compared to the controls (in such a scenario, samples below the value for that feature would be counted). ROC curves can be generated for a single feature as well as for other single outputs, for example, a combination of two or more features can be mathematically combined (e.g., added, subtracted, multiplied, etc.) to produce a single value, and this single value can be plotted in a ROC curve. Additionally, any combination of multiple features, in which the combination derives a single output value, can be plotted in a ROC curve. These combinations of features may comprise a test. The ROC curve is the plot of the sensitivity of a test against the specificity of the test, where sensitivity is traditionally presented on the vertical axis and specificity is traditionally presented on the horizontal axis. Thus, "AUC ROC values" are equal to the probability that a classifier will rank a randomly chosen positive instance higher than a randomly chosen negative one. An AUC ROC value may be thought of as equivalent to the Mann-Whitney U test, which tests for the median difference between scores obtained in the two groups considered if the groups are of continuous data, or to the Wilcoxon test of ranks.

In some embodiments, at least one (e.g., 1, 2, 3, 4, 5, 6, 7, 8, 9, 10, or more) IRS biomarker or a panel if IRS biomarkers is selected to discriminate between subjects with a first condition and subjects with a second condition with at least about 50%, 55% 60%, 65%, 70%, 75%, 80%, 85%, 90%, 95% accuracy or having a C-statistic of at least about 0.50, 0.55, 0.60, 0.65, 0.70, 0.75, 0.80, 0.85, 0.90, 0.95.

In the case of a positive likelihood ratio, a value of 1 indicates that a positive result is equally likely among subjects in both the "condition" and "control" groups; a value greater than 1 indicates that a positive result is more likely in the condition group; and a value less than 1 indicates that a positive result is more likely in the control group. In this context, "condition" is meant to refer to a group having one characteristic (e.g., the presence of a healthy condition, SIRS, inSIRS, ipSIRS, or a particular stage of ipSIRS) and "control" group lacking the same characteristic. In the case of a negative likelihood ratio, a value of 1 indicates that a negative result is equally likely among subjects in both the "condition" and "control" groups; a value greater than 1 indicates that a negative result is more likely in the "condition" group; and a value less than 1 indicates that a negative result is more likely in the "control" group. In the case of an odds ratio, a value of 1 indicates that a positive result is equally likely among subjects in both the condition" and "control" groups; a value greater than 1 indicates that a positive result is more likely in the "condition" group; and a value less than 1 indicates that a positive result is more likely in the "control" group. In the case of an AUC ROC value, this is computed by numerical integration of the ROC curve. The range of this value can be 0.5 to 1.0. A value of 0.5 indicates that a classifier (e.g., a IRS biomarker profile) is no better than a 50% chance to classify unknowns correctly between two groups of interest, while 1.0 indicates the relatively best diagnostic accuracy. In certain embodiments, IRS biomarkers and/or IRS biomarker panels are selected to exhibit a positive or negative likelihood ratio of at least about 1.5 or more or about 0.67 or less, at least about 2 or more or about 0.5 or less, at least about 5 or more or about 0.2 or less, at least about 10 or more or about 0.1 or less, or at least about 20 or more or about 0.05 or less.

In certain embodiments, IRS biomarkers and/or IRS biomarker panels are selected to exhibit an odds ratio of at least about 2 or more or about 0.5 or less, at least about 3 or more or about 0.33 or less, at least about 4 or more or about 0.25 or less, at least about 5 or more or about 0.2 or less, or at least about 10 or more or about 0.1 or less.

In certain embodiments, IRS biomarkers and/or IRS biomarker panels are selected to exhibit an AUC ROC value of greater than 0.5, preferably at least 0.6, more preferably 0.7, still more preferably at least 0.8, even more preferably at least 0.9, and most preferably at least 0.95.

In some cases, multiple thresholds may be determined in so-called "tertile," "quartile," or "quintile" analyses. In these methods, the "diseased" and "control groups" (or "high risk" and "low risk") groups are considered together as a single population, and are divided into 3, 4, or 5 (or more) "bins" having equal numbers of individuals. The boundary between two of these "bins" may be considered "thresholds." A risk (of a particular diagnosis or prognosis for example) can be assigned based on which "bin" a test subject falls into.

In other embodiments, particular thresholds for the IRS biomarker(s) measured are not relied upon to determine if the biomarker level(s) obtained from a subject are correlated to a particular diagnosis or prognosis. For example, a temporal change in the biomarker(s) can be used to rule in or out one or more particular diagnoses and/or prognoses. Alternatively, IRS biomarker(s) are correlated to a condition, disease, prognosis, etc., by the presence or absence of one or more IRS biomarkers in a particular assay format. In the case of IRS biomarker panels, the present invention may utilize an evaluation of the entire profile of IRS biomarkers to provide a single result value (e.g., a "panel response" value expressed either as a numeric score or as a percentage risk). In such embodiments, an increase, decrease, or other change (e.g., slope over time) in a certain subset of IRS biomarkers may be sufficient to indicate a particular condition or future outcome in one patient, while an increase, decrease, or other change in a different subset of IRS biomarkers may be sufficient to indicate the same or a different condition or outcome in another patient.

In certain embodiments, a panel of IRS biomarkers is selected to assist in distinguishing a pair of groups (i.e., assist in assessing whether a subject has an increased likelihood of being in one group or the other group of the pair) selected from "healthy condition" and "SIRS," "healthy condition" and "inSIRS," "healthy condition" and "ipSIRS," "inSIRS" and "ipSIRS," "mild sepsis" and "severe sepsis," "severe sepsis" and "septic shock," "mild sepsis" and "septic shock," or "low risk" and "high risk" with at least about 70%, 80%, 85%, 90% or 95% sensitivity, suitably in combination with at least about 70% 80%, 85%, 90% or 95% specificity. In some embodiments, both the sensitivity and specificity are at least about 75%, 80%, 85%, 90% or 95%.

The phrases "assessing the likelihood" and "determining the likelihood," as used herein, refer to methods by which the skilled artisan can predict the presence or absence of a condition (e.g., a condition selected from healthy condition, SIRS, inSIRS, ipSIRS, or a particular stage of ipSIRS) in a patient. The skilled artisan will understand that this phrase includes within its scope an increased probability that a condition is present or absence in a patient; that is, that a condition is more likely to be present or absent in a subject. For example, the probability that an individual identified as having a specified condition actually has the condition may be expressed as a "positive predictive value" or "PPV." Positive predictive value can be calculated as the number of true positives divided by the sum of the true positives and false positives. PPV is determined by the characteristics of the predictive methods of the present invention as well as the prevalence of the condition in the population analysed. The statistical algorithms can be selected such that the positive predictive value in a population having a condition prevalence is in the range of 70% to 99% and can be, for example, at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

In other examples, the probability that an individual identified as not having a specified condition actually does not have that condition may be expressed as a "negative predictive value" or "NPV." Negative predictive value can be calculated as the number of true negatives divided by the sum of the true negatives and false negatives. Negative predictive value is determined by the characteristics of the diagnostic or prognostic method, system, or code as well as the prevalence of the disease in the population analysed. The statistical methods and models can be selected such that the negative predictive value in a population having a condition prevalence is in the range of about 70% to about 99% and can be, for example, at least about 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

In some embodiments, a subject is determined as having a significant likelihood of having or nott having a specified condition. By "significant likelihood" is meant that the subject has a reasonable probability (0.6, 0.7, 0.8, 0.9 or more) of having, or not having, a specified condition.

The IRS biomarker analysis of the present invention permits the generation of high-density data sets that can be evaluated using informatics approaches. High data density informatics analytical methods are known and software is available to those in the art, e.g., cluster analysis (Pirouette, Informetrix), class prediction (SIMCA-P, Umetrics), principal components analysis of a computationally modeled dataset (SIMCA-P, Umetrics), 2D cluster analysis (GeneLinker Platinum, Improved Outcomes Software), and metabolic pathway analysis (biotech.icmb.utexas.edu). The choice of software packages offers specific tools for questions of interest (Kennedy et al., Solving Data Mining Problems Through Pattern Recognition. Indianapolis: Prentice Hall PTR, 1997; Golub et al., (2999) Science 286:531-7; Eriksson et al., Multi and Megavariate Analysis Principles and Applications: Umetrics, Umea, 2001). In general, any suitable mathematic analyses can be used to evaluate at least one (e.g., 1, 2, 3, 4, 5, 6, 7, 8, 9, 10, et.) IRS biomarker in an IRS biomarker profile with respect to a condition selected from healthy condition, SIRS, inSIRS, ipSIRS, or a particular stage of ipSIRS. For example, methods such as multivariate analysis of variance, multivariate regression, and/or multiple regression can be used to determine relationships between dependent variables (e.g., clinical measures) and independent variables (e.g., levels of IRS biomarkers). Clustering, including both hierarchical and non-hierarchical methods, as well as non-metric Dimensional Scaling can be used to determine associations or relationships among variables and among changes in those variables.

In addition, principal component analysis is a common way of reducing the dimension of studies, and can be used to interpret the variance-covariance structure of a data set. Principal components may be used in such applications as multiple regression and cluster analysis. Factor analysis is used to describe the covariance by constructing "hidden" variables from the observed variables. Factor analysis may be considered an extension of principal component analysis, where principal component analysis is used as parameter estimation along with the maximum likelihood method. Furthermore, simple hypothesis such as equality of two vectors of means can be tested using Hotelling's T squared statistic.

In some embodiments, the data sets corresponding to IRS biomarker profiles are used to create a diagnostic or predictive rule or model based on the application of a statistical and machine learning algorithm. Such an algorithm uses relationships between an IRS biomarker profile and a condition selected from healthy condition, SIRS, inSIRS, ipSIRS, or a particular stage of ipSIRS observed in control subjects or typically cohorts of control subjects (sometimes referred to as training data), which provides combined control or reference IRS biomarker profiles for comparison with IRS biomarker profiles of a subject. The data are used to infer relationships that are then used to predict the status of a subject, including the presence or absence of one of the conditions referred to above.

Figure 1:
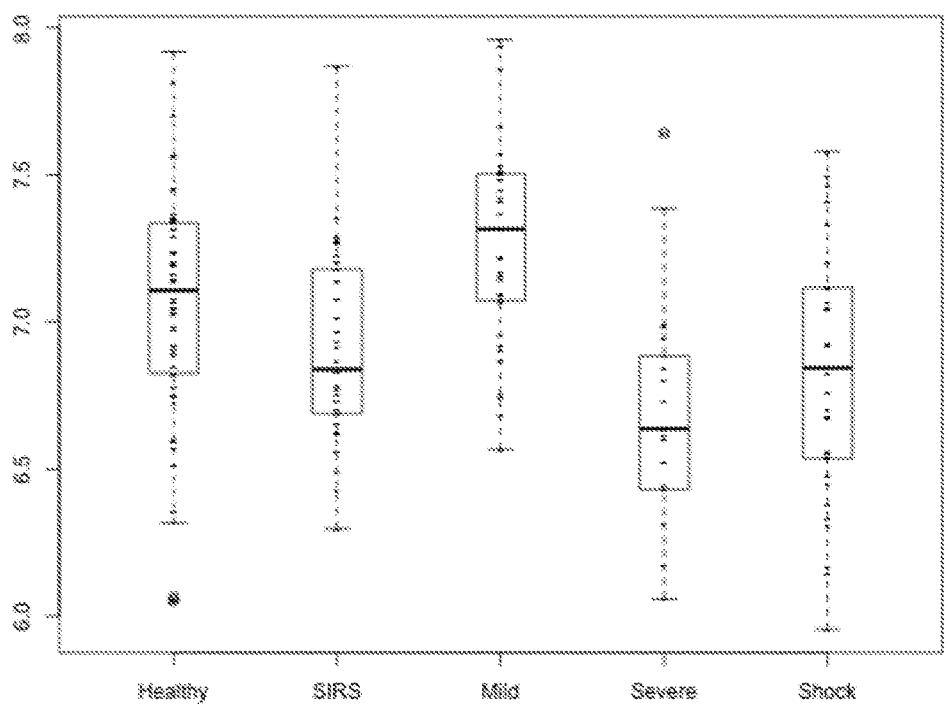
FIG. 1 shows a box and whiskers plot of PLEKHA3 gene expression for healthy subjects and subjects with SIRS, mild sepsis, severe sepsis.

Practitioners skilled in the art of data analysis recognize that many different forms of inferring relationships in the training data may be used without materially changing the present invention. The data presented in the Tables and Examples herein has been used to generate illustrative minimal combinations of IRS biomarkers (models) that differentiate between two conditions selected from healthy condition, SIRS, inSIRS, ipSIRS, or a particular stage of ipSIRS using feature selection based on AUC maximisation in combination with support vector machine classification. Tables 1-15 provide illustrative lists of IRS biomarkers ranked according to their p value and FIGS. 1-331 illustrate the ability of each IRS biomarker to distinguish between at least two of the conditions. Illustrative models comprising at least about 2 IRS biomarkers were able to discriminate between two control groups as defined above with significantly improved positive predictive values compared to conventional methodologies.

The term "correlating" generally refers to determining a relationship between one type of data with another or with a state. In various embodiments, correlating an IRS biomarker profile with the presence or absence of a condition (e.g., a condition selected from a healthy condition, SIRS, inSIRS, ipSIRS, or a particular stage of ipSIRS) comprises determining the presence, absence or amount of at least one IRS biomarker in a subject that suffers from that condition; or in persons known to be free of that condition. In specific embodiments, a profile of IRS biomarker levels, absences or presences is correlated to a global probability or a particular outcome, using receiver operating characteristic (ROC) curves.

Thus, in some embodiments, evaluation of IRS biomarkers includes determining the levels of individual IRS biomarkers, which correlate with the presence or absence of a condition, as defined above. In certain embodiments, the techniques used for detection of IRS biomarkers will include internal or external standards to permit quantitative or semi-quantitative determination of those biomarkers, to thereby enable a valid comparison of the level of the IRS biomarkers in a biological sample with the corresponding IRS biomarkers in a reference sample or samples. Such standards can be determined by the skilled practitioner using standard protocols. In specific examples, absolute values for the level or functional activity of individual expression products are determined.

In semi-quantitative methods, a threshold or cut-off value is suitably determined, and is optionally a predetermined value. In particular embodiments, the threshold value is predetermined in the sense that it is fixed, for example, based on previous experience with the assay and/or a population of affected and/or unaffected subjects. Alternatively, the predetermined value can also indicate that the method of arriving at the threshold is predetermined or fixed even if the particular value varies among assays or may even be determined for every assay run.

In some embodiments, the level of an IRS biomarker is normalized against a housekeeping biomarker. The term "housekeeping biomarker" refers to a biomarker or group of biomarkers (e.g., polynucleotides and/or polypeptides), which are typically found at a constant level in the cell type(s) being analysed and across the conditions being assessed. In some embodiments, the housekeeping biomarker is a "housekeeping gene." A "housekeeping gene" refers herein to a gene or group of genes which encode proteins whose activities are essential for the maintenance of cell function and which are typically found at a constant level in the cell type(s) being analysed and across the conditions being assessed.

Generally, the levels of individual IRS biomarkers in an IRS biomarker profile are derived from a biological sample. The term "biological sample" as used herein refers to a sample that may be extracted, untreated, treated, diluted or concentrated from an animal. The biological sample is suitably a biological fluid such as whole blood, serum, plasma, saliva, urine, sweat, ascitic fluid, peritoneal fluid, synovial fluid, amniotic fluid, cerebrospinal fluid, tissue biopsy, and the like. In certain embodiments, the biological sample contains blood, especially peripheral blood, or a fraction or extract thereof. Typically, the biological sample comprises blood cells such as mature, immature or developing leukocytes, including lymphocytes, polymorphonuclear leukocytes, neutrophils, monocytes, reticulocytes, basophils, coelomocytes, hemocytes, eosinophils, megakaryocytes, macrophages, dendritic cells natural killer cells, or fraction of such cells (e.g., a nucleic acid or protein fraction). In specific embodiments, the biological sample comprises leukocytes including peripheral blood mononuclear cells (PBMC).

The term "nucleic acid" or "polynucleotide" refers to a polymer, typically a heteropolymer, of nucleotides or the sequence of these nucleotides from the 5' to 3' end of a nucleic acid molecule and includes DNA or RNA molecules, illustrative examples of which include RNA, mRNA, siRNA, miRNA, hpRNA, cRNA, cDNA or DNA. The term encompasses a polymeric form of nucleotides that is linear or branched, single or double stranded, or a hybrid thereof. The term also encompasses RNA/DNA hybrids. Nucleic acid sequences provided herein are presented herein in the 5' to 3' direction, from left to right and are represented using the standard code for representing the nucleotide characters as set forth in the U.S. sequence rules, 37 CFR 1.821-1.825 and the World Intellectual Property Organization (WIPO) Standard ST.25.

"Protein," "polypeptide" and "peptide" are used interchangeably herein to refer to a polymer of amino acid residues and to variants and synthetic analogues of the same.

Suitably, the levels of individual IRS biomarkers in a reference IRS biomarker profile are derived from IRS biomarker samples obtained from one or more control subjects having that condition (e.g., "healthy control subjects," "SIRS control subjects," "inSIRS control subjects," "ipSIRS control subjects," "control subjects with a particular stage of ipSIRS," illustrative examples of which include "mild sepsis control subjects," "severe sepsis control subjects," and "septic shock control subjects," etc.), which are also referred to herein as control groups (e.g., "healthy control group," "SIRS control group," "inSIRS control group," "ipSIRS control group," "ipSIRS stage group," illustrative examples of which include "mild sepsis control group," "severe sepsis control group," and "septic shock control group," etc.). By "obtained" is meant to come into possession. Biological or reference samples so obtained include, for example, nucleic acid extracts or polypeptide extracts isolated or derived from a particular source. For instance, the extract may be isolated directly from a biological fluid or tissue of a subject.

As used herein the terms "level" and "amount" are used interchangeably herein to refer to a quantitative amount (e.g., weight or moles), a semi-quantitative amount, a relative amount (e.g., weight ° A) or mole ° A) within class or a ratio), a concentration, and the like. Thus, these terms encompasses absolute or relative amounts or concentrations of IRS biomarkers in a sample, including ratios of levels of IRS biomarkers, and odds ratios of levels or ratios of odds ratios. IRS biomarker levels in cohorts of subjects may be represented as mean levels and standard deviations as shown in the Tables and Figures herein.

In some embodiments, the level of at least one (e.g., 1, 2, 3, 4, 5, 6, 7, 8, 9, 10 etc.) IRS biomarker of the subject's sample IRS biomarker profile is compared to the level of a corresponding IRS biomarker in the reference IRS biomarker profile. By "corresponding IRS biomarker" is meant an IRS biomarker that is structurally and/or functionally similar to a reference IRS biomarker. Representative corresponding IRS biomarkers include expression products of allelic variants (same locus), homologs (different locus), and orthologs (different organism) of reference IRS biomarker genes. Nucleic acid variants of reference IRS biomarker genes and encoded IRS biomarker polynucleotide expression products can contain nucleotide substitutions, deletions, inversions and/or insertions. Variation can occur in either or both the coding and non-coding regions. The variations can produce both conservative and non-conservative amino acid substitutions (as compared in the encoded product). For nucleotide sequences, conservative variants include those sequences that, because of the degeneracy of the genetic code, encode the amino acid sequence of a reference IRS polypeptide.

Generally, variants of a particular IRS biomarker gene or polynucleotide will have at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to that particular nucleotide sequence as determined by sequence alignment programs known in the art using default parameters. In some embodiments, the IRS biomarker gene or polynucleotide displays at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a nucleotide sequence selected from any one of SEQ ID NO: 1-319.

Corresponding IRS biomarkers also include amino acid sequence that displays substantial sequence similarity or identity to the amino acid sequence of a reference IRS biomarker polypeptide. In general, an amino acid sequence that corresponds to a reference amino acid sequence will display at least about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence similarity or identity to a reference amino acid sequence selected from any one of SEQ ID NO: 320-619.

In some embodiments, calculations of sequence similarity or sequence identity between sequences are performed as follows:

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In some embodiments, the length of a reference sequence aligned for comparison purposes is at least 30%, usually at least 40%, more usually at least 50%, 60%, and even more usually at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide at the corresponding position in the second sequence, then the molecules are identical at that position. For amino acid sequence comparison, when a position in the first sequence is occupied by the same or similar amino acid residue (i.e., conservative substitution) at the corresponding position in the second sequence, then the molecules are similar at that position.

The percent identity between the two sequences is a function of the number of identical amino acid residues shared by the sequences at individual positions, taking into account the number of gaps, and the length of each gap, which need to be introduced for optimal alignment of the two sequences. By contrast, the percent similarity between the two sequences is a function of the number of identical and similar amino acid residues shared by the sequences at individual positions, taking into account the number of gaps, and the length of each gap, which need to be introduced for optimal alignment of the two sequences.

The comparison of sequences and determination of percent identity or percent similarity between sequences can be accomplished using a mathematical algorithm. In certain embodiments, the percent identity or similarity between amino acid sequences is determined using the Needleman and Wunsch, (1970, *J. Mol. Biol.* 48: 444-453) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. In specific embodiments, the percent identity between nucleotide sequences is determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. An non-limiting set of parameters (and the one that should be used unless otherwise specified) includes a Blossum 62 scoring matrix with a gap penalty of 12, a gap extend penalty of 4, and a frameshift gap penalty of 5.

In some embodiments, the percent identity or similarity between amino acid or nucleotide sequences can be determined using the algorithm of E. Meyers and W. Miller (1989, *Cabios*, 4: 11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al., (1990, *J. Mol. Biol*, 215: 403-10). BLAST nucleotide searches can be performed with the NBLAST program, score=100, wordlength=12 to obtain nucleotide sequences homologous to 53010 nucleic acid molecules of the invention. BLAST protein searches can be performed with the XBLAST program, score=50, wordlength=3 to obtain amino acid sequences homologous to 53010 protein molecules of the invention. To obtain gapped alignments for comparison purposes, Gapped BLAST can be utilized as described in Altschul et al., (1997, *Nucleic Acids Res*, 25: 3389-3402). When utilizing BLAST and Gapped BLAST programs, the default parameters of the respective programs (e.g., XBLAST and NBLAST) can be used.

Corresponding IRS biomarker polynucleotides also include nucleic acid sequences that hybridize to reference IRS biomarker polynucleotides, or to their complements, under stringency conditions described below. As used herein, the term "hybridizes under low stringency, medium stringency, high stringency, or very high stringency conditions" describes conditions for hybridization and washing. "Hybridization" is used herein to denote the pairing of complementary nucleotide sequences to produce a DNA-DNA hybrid or a DNA-RNA hybrid. Complementary base sequences are those sequences that are related by the base-pairing rules. In DNA, A pairs with T and C pairs with G. In RNA, U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently.

Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at room temperature. One embodiment of low stringency conditions includes hybridization in 6×sodium chloride/sodium citrate (SSC) at about 45□□C, followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45□□C, followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 7% mM EDTA, 0.5 M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45□□C, followed by one or more washes in 0.2×SSC, 0.1% SDS at 65° C.

In certain embodiments, a corresponding IRS biomarker polynucleotide is one that hybridizes to a disclosed nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C.

Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

Thus, in some embodiments, IRS biomarker levels in control groups as broadly defined above and elsewhere herein are used to generate a profile of IRS biomarker levels reflecting difference between levels in two control groups as described above and elsewhere herein. Thus, a particular IRS biomarker may be more abundant or less abundant in one control group as compared to another control group. The data may be represented as an overall signature score or the profile may be represented as a barcode or other graphical representation to facilitate analysis or diagnosis or determination of likelihood. The IRS biomarker levels from a test subject may be represented in the same way and the similarity with the signature score or level of "fit" to a signature barcode or other graphical representation may be determined. In other embodiments, the levels of a particular IRS biomarker are analysed and a downward or an upward trend in IRS biomarker level determined.

In some embodiments, the individual level of an IRS biomarker in a first control group (e.g., a control group selected from healthy condition control group, SIRS control group, inSIRS control group, ipSIRS control group, or ipSIRS stage control group) is at least 101%, 102%, 103%, 104%, 105%, 106%, 107% 108%, 109%, 110%, 120%, 130%, 140%, 150%, 160%, 170%, 180%, 190%, 200%, 300%, 400%, 500%, 600%, 700%, 800%, 900% or 1000% (i.e. an increased or higher level), or no more than about 99%, 98%, 97%, 96%, 95%, 94%, 93%, 92%, 91%, 90%, 80%, 70%, 60%, 50%, 40%, 30%, 20%, 10%, 5%, 4%, 3%, 2%, 1%, 0.5%, 0.1%, 0.01%, 0.001% or 0.0001% (i.e. a decreased or lower level) of the level of a corresponding IRS biomarker in a second control group (e.g., a control group selected from healthy condition control group, SIRS control group, inSIRS control group, ipSIRS control group, or ipSIRS stage control group, illustrative examples of which include "mild sepsis control group, severe sepsis control group, and septic shock control group, which is different from the first control group).

An IRS biomarker profile provides a compositional analysis (e.g., concentration or mole percentage (%) of the IRS biomarker) in which two or more, three or more, four or more, five or more, six or more, seven or more, eight or more, nine or more, ten or more, twelve or more, fifteen or more, twenty or more, fifty or more, one-hundred or more or a greater number of IRS biomarkers are evaluated.

The IRS biomarker profile can be quantitative, semi-quantitative and/or qualitative. For example, the IRS biomarker profile can evaluate the presence or absence of an IRS biomarker, can evaluate the presence of an IRS biomarker(s) above or below a particular threshold, and/or can evaluate the relative or absolute amount of an IRS biomarker(s). In particular embodiments, a ratio among two, three, four or more IRS biomarkers is determined (see Example 6 and Tables 16-21 for examples of the use of 2-gene ratios in separating various inSIRS and ipSIRS conditions). Changes or perturbations in IRS biomarker ratios can be advantageous in indicating where there are blocks (or releases of such blocks) or other alterations in cellular pathways associated with an IRS condition, response to treatment, development of side effects, and the like.

IRS biomarkers may be quantified or detected using any suitable technique including nucleic acid- and protein-based assays.

In illustrative nucleic acid-based assays, nucleic acid is isolated from cells contained in the biological sample according to standard methodologies (Sambrook, et al., 1989, supra; and Ausubel et al., 1994, supra). The nucleic acid is typically fractionated (e.g., poly A$^+$ RNA) or whole cell RNA. Where RNA is used as the subject of detection, it may be desired to convert the RNA to a complementary DNA. In some embodiments, the nucleic acid is amplified by a template-dependent nucleic acid amplification technique. A number of template dependent processes are available to amplify the IRS biomarker sequences present in a given template sample. An exemplary nucleic acid amplification technique is the polymerase chain reaction (referred to as PCR), which is described in detail in U.S. Pat. Nos. 4,683,195, 4,683,202 and 4,800,159, Ausubel et al. (supra), and in Innis et al., ("PCR Protocols", Academic Press, Inc., San Diego Calif., 1990). Briefly, in PCR, two primer sequences are prepared that are complementary to regions on opposite complementary strands of the biomarker sequence. An excess of deoxynucleotide triphosphates are added to a reaction mixture along with a DNA polymerase, e.g., Taq polymerase. If a cognate IRS biomarker sequence is present in a sample, the primers will bind to the biomarker and the polymerase will cause the primers to be extended along the biomarker sequence by adding on nucleotides. By raising and lowering the temperature of the reaction mixture, the extended primers will dissociate from the biomarker to form reaction products, excess primers will bind to the biomarker and to the reaction products and the process is repeated. A reverse transcriptase PCR amplification procedure may be performed in order to quantify the amount of mRNA amplified. Methods of reverse transcribing RNA into cDNA are well known and described in Sambrook et al., 1989, supra. Alternative methods for reverse transcription utilize thermostable, RNA-dependent DNA polymerases. These methods are described in WO 90/07641. Polymerase chain reaction methodologies are well known in the art.

In certain advantageous embodiments, the template-dependent amplification involves quantification of transcripts in real-time. For example, RNA or DNA may be quantified using the Real-Time PCR technique (Higuchi, 1992, et al., *Biotechnology* 10: 413-417). By determining the concentration of the amplified products of the target DNA in PCR reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundance of the specific mRNA from which the target sequence was derived can be determined for the respective tissues or cells. This direct proportionality between the concentration of the PCR products and the relative mRNA abundance is only true in the linear range of the PCR reaction. The final concentration of the target DNA in the plateau portion of the curve is determined by the availability of reagents in the reaction mix and is independent of the original concentration of target DNA. In specific embodiments, multiplexed, tandem PCR (MT-PCR) is employed, which uses a two-step process for gene expression profiling from small quantities of RNA or DNA, as described for example in US Pat. Appl. Pub. No. 20070190540. In the first step, RNA is converted into cDNA and amplified using multiplexed gene specific primers. In the second step each individual gene is quantitated by real time PCR.

In certain embodiments, target nucleic acids are quantified using blotting techniques, which are well known to those of skill in the art. Southern blotting involves the use of DNA as a target, whereas Northern blotting involves the use of RNA as a target. Each provides different types of information, although cDNA blotting is analogous, in many aspects, to blotting or RNA species. Briefly, a probe is used to target a DNA or RNA species that has been immobilized on a suitable matrix, often a filter of nitrocellulose. The different species should be spatially separated to facilitate analysis. This often is accomplished by gel electrophoresis of nucleic acid species followed by "blotting" on to the filter. Subsequently, the blotted target is incubated with a probe (usually labelled) under conditions that promote denaturation and rehybridisation. Because the probe is designed to base pair with the target, the probe will bind a portion of the target sequence under renaturing conditions. Unbound probe is then removed, and detection is accomplished as described above. Following detection/quantification, one may compare the results seen in a given subject with a control reaction or a statistically significant reference group or population of control subjects as defined herein. In this way, it is possible to correlate the amount of a IRS biomarker nucleic acid detected with the progression or severity of the disease.

Also contemplated are biochip-based technologies such as those described by Hacia et al. (1996, *Nature Genetics* 14: 441-447) and Shoemaker et al. (1996, *Nature Genetics* 14: 450-456). Briefly, these techniques involve quantitative methods for analysing large numbers of genes rapidly and accurately. By tagging genes with oligonucleotides or using fixed probe arrays, one can employ biochip technology to segregate target molecules as high-density arrays and screen these molecules on the basis of hybridization. See also Pease et al. (1994, *Proc. Natl. Acad. Sci. U.S.A.* 91: 5022-5026); Fodor et al. (1991, *Science* 251: 767-773). Briefly, nucleic acid probes to IRS biomarker polynucleotides are made and attached to biochips to be used in screening and diagnostic methods, as outlined herein. The nucleic acid probes attached to the biochip are designed to be substantially complementary to specific expressed IRS biomarker nucleic acids, i.e., the target sequence (either the target sequence of the sample or to other probe sequences, for example in sandwich assays), such that hybridization of the target sequence and the probes of the present invention occur. This complementarity need not be perfect; there may be any number of base pair mismatches, which will interfere with hybridization between the target sequence and the nucleic acid probes of the present invention. However, if the number of mismatches is so great that no hybridization can occur under even the least stringent of hybridization conditions, the sequence is not a complementary target sequence. In certain embodiments, more than one probe per sequence is used, with either overlapping probes or probes to different sections of the target being used. That is, two, three, four or more probes, with three being desirable, are used to build in a redundancy for a particular target. The probes can be overlapping (i.e. have some sequence in common), or separate.

In an illustrative biochip analysis, oligonucleotide probes on the biochip are exposed to or contacted with a nucleic acid sample suspected of containing one or more IRS biomarker polynucleotides under conditions favouring specific hybridization. Sample extracts of DNA or RNA, either single or double-stranded, may be prepared from fluid suspensions of biological materials, or by grinding biological materials, or following a cell lysis step which includes, but is not limited to, lysis effected by treatment with SDS (or other detergents), osmotic shock, guanidinium isothiocyanate and lysozyme. Suitable DNA, which may be used in the method of the invention, includes cDNA. Such DNA may be prepared by any one of a number of commonly used protocols as for example described in Ausubel, et al., 1994, supra, and Sambrook, et al., et al., 1989, supra.

Suitable RNA, which may be used in the method of the invention, includes messenger RNA, complementary RNA transcribed from DNA (cRNA) or genomic or subgenomic RNA. Such RNA may be prepared using standard protocols as for example described in the relevant sections of Ausubel, et al. 1994, supra and Sambrook, et al. 1989, supra).

cDNA may be fragmented, for example, by sonication or by treatment with restriction endonucleases. Suitably, cDNA is fragmented such that resultant DNA fragments are of a length greater than the length of the immobilized oligonucleotide probe(s) but small enough to allow rapid access thereto under suitable hybridization conditions. Alternatively, fragments of cDNA may be selected and amplified using a suitable nucleotide amplification technique, as described for example above, involving appropriate random or specific primers.

Usually the target IRS biomarker polynucleotides are detectably labelled so that their hybridization to individual probes can be determined. The target polynucleotides are typically detectably labelled with a reporter molecule illustrative examples of which include chromogens, catalysts, enzymes, fluorochromes, chemiluminescent molecules, bioluminescent molecules, lanthanide ions (e.g., $Eu^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like. Illustrative labels of this type include large colloids, for example, metal colloids such as those from gold, selenium, silver, tin and titanium oxide. In some embodiments in which an enzyme is used as a direct visual label, biotinylated bases are incorporated into a target polynucleotide.

The hybrid-forming step can be performed under suitable conditions for hybridizing oligonucleotide probes to test nucleic acid including DNA or RNA. In this regard, reference may be made, for example, to NUCLEIC ACID HYBRIDIZATION, A PRACTICAL APPROACH (Homes and Higgins, eds.) (IRL press, Washington D.C., 1985). In general, whether hybridization takes place is influenced by the length of the oligonucleotide probe and the polynucleotide sequence under test, the pH, the temperature, the concentration of mono- and divalent cations, the proportion of G and C nucleotides in the hybrid-forming region, the viscosity of the medium and the possible presence of denaturants. Such variables also influence the time required for hybridization. The preferred conditions will therefore depend upon the particular application. Such empirical conditions, however, can be routinely determined without undue experimentation.

After the hybrid-forming step, the probes are washed to remove any unbound nucleic acid with a hybridization buffer. This washing step leaves only bound target polynucleotides. The probes are then examined to identify which probes have hybridized to a target polynucleotide.

The hybridization reactions are then detected to determine which of the probes has hybridized to a corresponding target sequence. Depending on the nature of the reporter molecule associated with a target polynucleotide, a signal may be instrumentally detected by irradiating a fluorescent label with light and detecting fluorescence in a fluorimeter; by providing for an enzyme system to produce a dye which could be detected using a spectrophotometer; or detection of a dye particle or a coloured colloidal metallic or non metallic particle using a reflectometer; in the case of using a radioactive label or chemiluminescent molecule employing a radiation counter or autoradiography. Accordingly, a detection means may be adapted to detect or scan light associated with the label which light may include fluorescent, luminescent, focussed beam or laser light. In such a case, a charge couple device (CCD) or a photocell can be used to scan for emission of light from a probe:target polynucleotide hybrid from each location in the micro-array and record the data directly in a digital computer. In some cases, electronic detection of the signal may not be necessary. For example, with enzymatically generated colour spots associated with nucleic acid array format, visual examination of the array will allow interpretation of the pattern on the array. In the case of a nucleic acid array, the detection means is suitably interfaced with pattern recognition software to convert the pattern of signals from the array into a plain language genetic profile. In certain embodiments, oligonucleotide probes specific for different IRS biomarker polynucleotides are in the form of a nucleic acid array and detection of a signal generated from a reporter molecule on the array is performed using a 'chip reader'. A detection system that can be used by a 'chip reader' is described for example by Pirrung et al (U.S. Pat. No. 5,143,854). The chip reader will typically also incorporate some signal processing to determine whether the signal at a particular array position or feature is a true positive or maybe a spurious signal. Exemplary chip readers are described for example by Fodor et al (U.S. Pat. No. 5,925,525). Alternatively, when the array is made using a mixture of individually addressable kinds of labelled microbeads, the reaction may be detected using flow cytometry.

In other embodiments, IRS biomarker protein levels are assayed using protein-based assays known in the art. For example, when an IRS biomarker protein is an enzyme, the protein can be quantified based upon its catalytic activity or based upon the number of molecules of the protein contained in a sample. Antibody-based techniques may be employed including, for example, immunoassays, such as the enzyme-linked immunosorbent assay (ELISA) and the radioimmunoassay (RIA).

In specific embodiments, protein-capture arrays that permit simultaneous detection and/or quantification of a large number of proteins are employed. For example, low-density protein arrays on filter membranes, such as the universal protein array system (Ge, 2000 Nucleic Acids Res. 28(2):e3) allow imaging of arrayed antigens using standard ELISA techniques and a scanning charge-coupled device (CCD) detector. Immuno-sensor arrays have also been developed that enable the simultaneous detection of clinical analytes. It is now possible using protein arrays, to profile protein expression in bodily fluids, such as in sera of healthy or diseased subjects, as well as in subjects pre- and post-drug treatment.

Exemplary protein capture arrays include arrays comprising spatially addressed antigen-binding molecules, commonly referred to as antibody arrays, which can facilitate extensive parallel analysis of numerous proteins defining a proteome or subproteome. Antibody arrays have been shown to have the required properties of specificity and acceptable background, and some are available commercially (e.g., BD Biosciences, Clontech, BioRad and Sigma). Various methods for the preparation of antibody arrays have been reported (see, e.g., Lopez et al., 2003 J. Chromatogr. B 787:19-27; Cahill, 2000 Trends in Biotechnology 7:47-51; U.S. Pat. App. Pub. 2002/0055186; U.S. Pat. App. Pub. 2003/0003599; PCT publication WO 03/062444; PCT publication WO 03/077851; PCT publication WO 02/59601; PCT publication WO 02/39120; PCT publication WO 01/79849; PCT publication WO 99/39210). The antigen-binding molecules of such arrays may recognise at least a subset of proteins expressed by a cell or population of cells, illustrative examples of which include growth factor receptors, hormone receptors, neurotransmitter receptors, catecholamine receptors, amino acid derivative receptors, cytokine receptors, extracellular matrix receptors, antibodies, lectins, cytokines, serpins, proteases, kinases, phosphatases, ras-like GTPases, hydrolases, steroid hormone receptors, transcription factors, heat-shock transcription factors, DNA-binding proteins, zinc-finger proteins, leucine-zipper proteins, homeodomain proteins, intracellular signal transduction modulators and effectors, apoptosis-related factors, DNA synthesis factors, DNA repair factors, DNA recombination factors and cell-surface antigens.

Individual spatially distinct protein-capture agents are typically attached to a support surface, which is generally planar or contoured. Common physical supports include glass slides, silicon, microwells, nitrocellulose or PVDF membranes, and magnetic and other microbeads.

Particles in suspension can also be used as the basis of arrays, providing they are coded for identification; systems include colour coding for microbeads (e.g., available from Luminex, Bio-Rad and Nanomics Biosystems) and semiconductor nanocrystals (e.g., QDots™, available from Quantum Dots), and barcoding for beads (UltraPlex™, available from Smartbeads) and multimetal microrods (Nanobarcodes™ particles, available from Surromed). Beads can also be assembled into planar arrays on semiconductor chips (e.g., available from LEAPS technology and BioArray Solutions). Where particles are used, individual protein-capture agents are typically attached to an individual particle to provide the spatial definition or separation of the array. The particles may then be assayed separately, but in parallel, in a compartmentalized way, for example in the wells of a microtiter plate or in separate test tubes.

In operation, a protein sample, which is optionally fragmented to form peptide fragments (see, e.g., U.S. Pat. App. Pub. 2002/0055186), is delivered to a protein-capture array under conditions suitable for protein or peptide binding, and the array is washed to remove unbound or non-specifically bound components of the sample from the array. Next, the presence or amount of protein or peptide bound to each feature of the array is detected using a suitable detection system. The amount of protein bound to a feature of the array may be determined relative to the amount of a second protein bound to a second feature of the array. In certain embodiments, the amount of the second protein in the sample is already known or known to be invariant.

For analysing differential expression of proteins between two cells or cell populations, a protein sample of a first cell or population of cells is delivered to the array under conditions suitable for protein binding. In an analogous manner, a protein sample of a second cell or population of cells to a second array is delivered to a second array that is identical to the first array. Both arrays are then washed to remove unbound or non-specifically bound components of the sample from the arrays. In a final step, the amounts of protein remaining bound to the features of the first array are compared to the amounts of protein remaining bound to the corresponding features of the second array. To determine the differential protein expression pattern of the two cells or populations of cells, the amount of protein bound to individual features of the first array is subtracted from the amount of protein bound to the corresponding features of the second array.

All the essential materials and reagents required for detecting and quantifying IRS biomarker expression products may be assembled together in a kit, which is encompassed by the present invention. The kits may also optionally include appropriate reagents for detection of labels, positive and negative controls, washing solutions, blotting membranes, microtiter plates dilution buffers and the like. For example, a nucleic acid-based detection kit may include (i) an IRS biomarker polynucleotide (which may be used as a positive control), (ii) a primer or probe that specifically hybridizes to an IRS biomarker polynucleotide. Also included may be enzymes suitable for amplifying nucleic acids including various polymerases (Reverse Transcriptase, Taq, Sequenase™, DNA ligase etc. depending on the nucleic acid amplification technique employed), deoxynucleotides and buffers to provide the necessary reaction mixture for amplification. Such kits also generally will comprise, in suitable means, distinct containers for each individual reagent and enzyme as well as for each primer or probe. Alternatively, a protein-based detection kit may include (i) an IRS biomarker polypeptide (which may be used as a positive control), (ii) an antibody that binds specifically to an IRS biomarker polypeptide. The kit can also feature various devices (e.g., one or more) and reagents (e.g., one or more) for performing one of the assays described herein; and/or printed instructions for using the kit to quantify the expression of an IRS biomarker gene.

In some embodiments, the methods and kits comprise or enable: comparing the level of at least one (e.g., 1, 2, 3, 4, 5, 6, 7, 8, 9, 10 etc.) IRS biomarker in the subject's sample IRS profile to the level of a corresponding IRS biomarker in a reference IRS biomarker profile from at least one control subject or group selected from a healthy control subject or group (hereafter referred to as a "reference healthy IRS biomarker profile"), a SIRS control subject or group (hereafter referred to as a "reference SIRS IRS biomarker profile"), an inSIRS control subject or group (hereafter referred to as a "reference inSIRS IRS biomarker profile"), an ipSIRS control subject or group (hereafter referred to as a "reference ipSIRS IRS biomarker profile") and a control subject or group with a particular stage of ipSIRS (hereafter referred to as a "reference ipSIRS stage IRS biomarker profile"), wherein a similarity between the level of the at least one IRS biomarker in the sample IRS biomarker profile and the level of the corresponding IRS biomarker in the reference healthy IRS biomarker profile identifies that the subject has an IRS biomarker profile that correlates with the presence of a healthy condition, or alternatively the absence of inSIRS, ipSIRS, or a particular stage of ipSIRS, wherein a similarity between the level of the at least one IRS biomarker in the sample IRS biomarker profile and the level of the corresponding IRS biomarker in the SIRS IRS biomarker profile identifies that the subject has an IRS biomarker profile that correlates with the presence of inSIRS or ipSIRS, or alternatively the absence of a healthy condition, wherein a similarity between the level of the at least one IRS biomarker in the sample IRS biomarker profile and the level of the corresponding IRS biomarker in the inSIRS IRS biomarker profile identifies that the subject has an IRS biomarker profile that correlates with the presence of inSIRS, or alternatively the absence of a healthy condition, ipSIRS, or a particular stage of ipSIRS, wherein a similarity between the level of the at least one IRS biomarker in the sample IRS biomarker profile and the level of the corresponding IRS biomarker in the ipSIRS IRS biomarker profile identifies that the subject has an IRS biomarker profile that correlates with the presence of ipSIRS, or alternatively the absence of a healthy condition or inSIRS, and wherein a similarity between the level of the at least one IRS biomarker in the sample IRS biomarker profile and the level of the corresponding IRS biomarker in the ipSIRS stage IRS biomarker profile identifies that the subject has an IRS biomarker profile that correlates with the presence of a particular stage of ipSIRS, or alternatively the absence of a healthy condition or inSIRS.

A subset of the instantly disclosed IRS biomarkers has been identified as being useful for assisting in distinguishing between healthy subjects and unhealthy subjects that have SIRS (i.e., sick subjects with either inSIRS or ipSIRS). Thus, in some embodiments, the methods and kits involve determining the likelihood that SIRS or a healthy condition (e.g., a normal condition or a condition in which SIRS is absent) is present or absent in a subject. These methods and kits generally comprise or involve: 1) providing a correlation of a reference IRS biomarker profile with the presence or absence of SIRS or the healthy condition, wherein the reference biomarker profile evaluates at least one (e.g., 1, 2, 3, 4, 5, 6, 7, 8, 9, 10 etc.) IRS biomarker selected from CD177, CLEC4D, BMX, VNN1, GPR84, ARG1, IL18R1, ERLIN1, IMP3, TLR5, UBE2J1, GPR56, FCGR1A, SLC1A3, SLC37A3, FAIM3, C3AR1, RNASE2, TNFAIP6, GNLY, OMG, FAR2, OLAH, CAMK4, METTL7B, B3GNT5, CLEC4E, MMP9, KREMEN1, GALNT3, PTGDR, TDRD9, GK3P, FKBP5, STOM, SMPDL3A, PFKFB2, ANKRD34B, SGMS2, DNAJC13, LRRN3, SH2D1B, C1orf161, HIST1H4C, IFI16, ACER3, PLB1, C9orf72, HMGB2, KLRK1, C7orf53, GOT2, TCN1, DSE, CCR3, CRIP1, ITK, KLRF1, TGFBR1, GSR, HIST1H4E, HPGD, FRMD3, ABCA13, C11orf82, PPP2R5A, BPI, CASS4, AP3B2, ODZ1, TMTC1, ADM, FGFBP2, HSPC159, HLA-DRA, HIST1H3I, TMEM144, MRPL41, FOLR3, PICALM, SH3PXD2B, DDAH2, HLA-DPB1, KPNA5, PHOSPHO1, TPST1, EIF2AK2, OR9A2, OLFM4, CD163, CDA, CHI3L1, MTHFS, CLU, ANAPC11, JUP, PMAIP1, GIMAP7, KLRD1, CCR1, CD274, EFCAB2, SUCNR1, KCNMA1, LGALS2, SLC11A1, FOXD4L3, VAMP2, ITGA4, LHFP, PRR13, FFAR2, B3GAT3, EAF2, HPSE, CLC, TLR10, CCR4, HIST1H3A, CENPK, DPH3, HLA-DPA1, ATP13A3, DNAJC9, S100B, HIST1H3J, 110, RPL17, C15orf54, LRRC70, IL5RA, PLA2G7, ECHDC3, HINT1, LCN2, PPIF, SLC15A2, PMS2CL, HIST1H2AA, CEACAM8, HSP90AB1, ABCG1, PDGFC, NPCDR1, PDK4, GAB2, WSB2, FAM118A, JKAMP, TREML1, PYHIN1, IRF4, ABCA1, DAAM2, ACPL2, RCBTB2, SAP30, THBS1, PCOLCE2, GPR65, NF-E4, LTF, LASS4, B4GALT3, RETN, TIMM10, IL1B, CLEC4A, SEC24A, RUNX2, LRRFIP1, CFD, EIF1AX, ZRANB1, SULF2, EXOSC4, CCDC125, LOC284757, ANKRD28, HIST1H2AJ, CD63, PLIN2, SON, HIST1H4L, KRTAP15-1, DLEU2, MYL9, FABP2, CD24, MACF1, GSTO1, RRP12, AIG1, RASA4, FBXL13, PDE3B, CCRL2, C1orf128, E2F6, IL1RL1, CEACAM6, CYP4F3, 199, TAAR1, TSHZ2, PLB1, UBE2F (where if a gene name is not provided then a SEQ ID NO. is provided); (2) obtaining a sample IRS biomarker profile from the subject, which evaluates for an individual IRS biomarker in the reference IRS biomarker profile a corresponding IRS biomarker, and (3) determining a likelihood of the subject having or not having the healthy condition or SIRS based on the sample IRS biomarker profile and the reference IRS biomarker profile.

In illustrative examples of this type, a reference healthy condition IRS biomarker profile comprises at least one (e.g., 1, 2, 3, 4, 5, 6, 7, 8, 9, 10 etc.) IRS biomarker that is downregulated or underexpressed relative to a reference SIRS IRS biomarker profile, illustrative examples of which include: GNLY, GPR56, KLRF1, HIST1H2AJ, HIST1H4C, KLRK1, CHI3L1, SH2D1B, PTGDR, CAMK4, FAIM3, CRIP1, CLC, HLA-DPB1, FGFBP2, HIST1H3J, IMP3, ITK, HIST1H3I, LRRN3, KLRD1, PHOSPHO1, CCR3, HIST1H4E, MRPL41, HIST1H3A, HLA-DRA, GIMAP7, KPNA5, CENPK, HLA-DPA1, HINT1, HIST1H4L, GOT2, DNAJC9, PLA2G7, CASS4, CFD, ITGA4, HSP90AB1, IL5RA, PMAIP1, LGALS2, SULF2, C1orf128, RPL17, EIF1AX, PYHIN1, S100B, PMS2CL, CCR4, C15orf54, VAMP2, ANAPC11, B3GAT3, E2F6, NPCDR1, FAM118A, PPIF, 199, JUP, B4GALT3, TIMM10, RUNX2, RASA4, SON, ABCG1, TSHZ2, IRF4, PDE3B, RRP12, LASS4 (where if a gene name is not provided then a SEQ ID NO. is provided). is provided).

In other illustrative examples, a reference healthy condition IRS biomarker profile comprises at least one (e.g., 1, 2, 3, 4, 5, 6, 7, 8, 9, 10 etc.) IRS biomarker that is upregulated or overexpressed relative to a reference SIRS IRS biomarker profile, non-limiting examples of which include: CD177, ARG1, VNN1, CLEC4D, GPR84, IL18R1, OLFM4, FCGR1A, RNASE2, TLR5, TNFAIP6, PFKFB2, C3AR1, TCN1, BMX, FKBP5, TDRD9, OLAH, ERLIN1, LCN2, MMP9, BPI, CEACAM8, CLEC4E, HPGD, CD274, GK3P, KREMEN1, ANKRD34B, SLC37A3, CD163, TMTC1, PLB1, UBE2J1, TPST1, B3GNT5, SMPDL3A, FAR2, ACER3, ODZ1, HMGB2, LTF, SGMS2, EIF2AK2, TMEM144, GALNT3, DNAJC13, IFI16, C11orf82, ABCA13, CD24, METTL7B, FOLR3, C7orf53, SLC1A3, DAAM2, HSPC159, OMG, CCR1, TREML1, STOM, CEACAM6, FOXD4L3, C9orf72, GSR, DSE, THBS1, SH3PXD2B, PDGFC, KCNMA1, PICALM, TLR10, PDK4, ADM, CLU, C1orf161, NF-E4, HPSE, FFAR2, PPP2R5A, CDA, NA, ATP13A3, ABCA1, TGFBR1, OR9A2, EFCAB2, EAF2, AP3B2, SLC15A2, ECHDC3, MTHFS, IL1B, WSB2, SUCNR1, DDAH2, CLEC4A, MACF1, MYL9, IL1RL1, EXOSC4, FBXL13, LOC284757, PRR13, DPH3, SLC11A1, FRMD3, ACPL2, PLB1, RETN, RCBTB2, CD63, CYP4F3, SEC24A, ZRANB1, CCDC125, PCOLCE2, JKAMP, LRRFIP1, GPR65, ANKRD28, LRRC70, AIG1, UBE2F, GAB2, CCRL2, SAP30, DLEU2, HIST1H2AA, GSTO1, PLIN2, LHFP, KRTAP15-1, TAAR1, FABP2 (where if a gene name is not provided then a SEQ ID NO. is provided).

In still other illustrative examples, a reference healthy condition IRS biomarker profile comprises: (1) at least one IRS biomarker that is downregulated or underexpressed relative to a reference SIRS IRS biomarker profile, as broadly described above and (2) at least one IRS biomarker that is upregulated or overexpressed relative to a reference SIRS IRS biomarker profile, as broadly described above.

The term "upregulated," "overexpressed" and the like refer to an upward deviation in the level of expression of an IRS biomarker as compared to a baseline expression level of a corresponding IRS biomarker in a control sample.

The term "downregulated," "underexpressed" and the like refer to a downward deviation in the level of expression of an IRS biomarker as compared to a baseline expression level of a corresponding IRS biomarker in a control sample.

Another subset of the instantly disclosed IRS biomarkers has been identified as being useful for assisting in distinguishing between healthy subjects, inSIRS affected subjects and subjects having ipSIRS. Accordingly, in some embodiments, the methods and kits are useful for determining the likelihood that inSIRS, ipSIRS or a healthy condition (e.g., a normal condition or a condition in which SIRS is absent) is present or absent in a subject. These methods and kits generally comprise or involve: 1) providing a correlation of a reference IRS biomarker profile with the likelihood of having or not having inSIRS, ipSIRS or the healthy condition, wherein the reference biomarker profile evaluates at least one (e.g., 1, 2, 3, 4, 5, 6, 7, 8, 9, 10 etc.) IRS biomarker selected from PLAC8, 132, INSIG1, CDS2, VOPP1, SLC39A9, B3GAT3, CD300A, OCR1, PTGER2, LGALS1, HIST1H4L, AMFR, SIAE, SLC39A8, TGFBR1, GAB2, MRPL41, TYMS, HIST1H3B, MPZL3, KIAA1257, OMG, HIST1H2BM, TDRD9, C22orf37, GALNT3, SYNE2, MGST3, HIST1H3I, LOC284757, TRAF3, HIST1H3C, STOM, C3AR1, KIAA0101, TNFRSF17, HAL, UBE2J1, GLT25D1, CD151, HSPB1, IMP3, PICALM, ACER3, IGL@, HIST1H2BJ, CASS4, KREMEN1, IRS2, APOLD1, RBP7, DNAJC13, ERGIC1, FSD1L, TLR5, TMEM62, SDHC, C9orf72, NP, KIAA0746, PMAIP1, DSE, SMPDL3A, DNAJC9, HIST1H3H, CDC26, CRIP1, FAR2, FRMD3, RGS2, METTL7B, CLEC4E, MME, ABCA13, PRR13, HIST1H4C, RRP12, GLDC, ECHDC3, IRF1, C7orf53, IGK@, RNASE2, FCGR1A, SAP30, PMS2CL, SLC11A1, AREG, PLB1, PPIF, GSR, NFXL1, AP3B2, DCTN5, RPL17, IGLV6-57, KLRF1, CHI3L1, ANKRD34B, OLFM4, CPM, CCDC125, GPR56, PPP1R2, 110, ACPL2, HIST1H3A, C7orf58, IRF4, ANAPC11, HIST1H3J, KLRD1, GPR84, ZRANB1, KDM6B, TPST1, HINT1, DAAM2, PTGDR, FKBP5, HSP90AB1, HPGD, IFI16, CD177, TAS2R31, CD163, B4GALT3, EIF1AX, CYP4F3, HIST1H2AA, LASS4 (where if a gene name is not provided then a SEQ ID NO. is provided).; (2) obtaining a sample IRS biomarker profile from the subject, which evaluates for an individual IRS biomarker in the reference IRS biomarker profile a corresponding IRS biomarker; and (3) determining a likelihood of the subject having or not having inSIRS, ipSIRS or a healthy condition the condition based on the sample IRS biomarker profile and the reference IRS biomarker profile.

In illustrative examples of this type, a reference healthy condition IRS biomarker profile comprises at least one (e.g., 1, 2, 3, 4, 5, 6, 7, 8, 9, 10 etc.) IRS biomarker that is downregulated or underexpressed relative to a reference inSIRS IRS biomarker profile, representative examples of which include: CD177, CLEC4E, FKBP5, CD163, TPST1, DAAM2, GPR84, FCGR1A, IFI16, RNASE2, TLR5, ECHDC3, OCR1, MME, LOC284757, 110, C3AR1, HAL, PRR13, ACPL2, SLC11A1, CYP4F3, SAP30, OLFM4, ZRANB1, GAB2, CCDC125, KREMEN1, UBE2J1, AREG, FAR2, CPM, PLB1, ERGIC1, RGS2, 132, HPGD, ANKRD34B, TDRD9, DNAJC13, GALNT3, IRS2, HIST1H2AA, RBP7, KDM6B, ACER3, MPZL3, KIAA1257, C7orf53, C9orf72, STOM, METTL7B, SMPDL3A, GSR, SYNE2, OMG, DSE, PICALM, ABCA13, PPP1R2, TGFBR1, AP3B2, FRMD3 (where if a gene name is not provided then a SEQ ID NO. is provided).

In other illustrative examples, a reference healthy condition IRS biomarker profile comprises at least one (e.g., 1, 2, 3, 4, 5, 6, 7, 8, 9, 10 etc.) IRS biomarker that is upregulated or overexpressed, relative to a reference inSIRS IRS biomarker profile, illustrative examples of which include: SIAE, FSD1L, GLDC, HSPB1, HIST1H2BJ, CDS2, CASS4, DCTN5, SLC39A9, CDC26, LGALS1, CD151, NP, TYMS, IGLV6-57, TMEM62, CD300A, LASS4, GLT25D1, IRF1, AMFR, IGL@, NFXL1, SLC39A8, APOLD1, TNFRSF17, KIAA0101, C22orf37, VOPP1, KLRD1, TRAF3, RRP12, PTGER2, KIAA0746, MGST3, CHI3L1, TAS2R31, SDHC, IRF4, INSIG1, PPIF, B4GALT3, ANAPC11, PLAC8, HIST1H2BM, KLRF1, B3GAT3, C7orf58, PMS2CL, PTGDR, RPL17, EIF1AX, PMAIP1, HIST1H3B, IGK@, HINT1, HSP90AB1, GPR56, HIST1H3H, HIST1H3A, IMP3, DNAJC9, MRPL41, HIST1H3J, HIST1H3C, HIST1H3I, HIST1H4L, CRIP1, HIST1H4C (where if a gene name is not provided then a SEQ ID NO. is provided).

In still other illustrative examples, a reference healthy condition IRS biomarker profile comprises: (1) at least one IRS biomarker that is downregulated or underexpressed relative to a reference inSIRS IRS biomarker profile, as broadly described above and (2) at least one IRS biomarker that is upregulated or overexpressed relative to a reference inSIRS IRS biomarker profile, as broadly described above.

In other illustrative examples, a reference inSIRS IRS biomarker profile comprises at least one (e.g., 1, 2, 3, 4, 5, 6, 7, 8, 9, 10 etc.) IRS biomarker that is downregulated or underexpressed relative to a reference ipSIRS IRS biomarker profile, representative examples of which include: OLFM4, PLAC8, HIST1H4L, HIST1H3C, TDRD9, IGK@, HIST1H3B, HIST1H2BM, HPGD, GPR84, TLR5, SMPDL3A, CD177, HIST1H3I, C3AR1, DNAJC9, ABCA13, ANKRD34B, RNASE2, FCGR1A, HIST1H3H, KIAA0746, ACER3, SDHC, CRIP1, IGLV6-57, PLB1, MRPL41, HIST1H4C, SLC39A8, NP, NFXL1, PTGER2, TYMS, LGALS1, C7orf58, CD151, KREMEN1, AMFR, METTL7B, TNFRSF17, HSP90AB1, VOPP1, GLT25D1, GALNT3, OMG, SIAE, FAR2, C7orf53, DNAJC13, HIST1H2BJ, KIAA0101, HSPB1, UBE2J1, HIST1H3J, CDS2, MGST3, PICALM, HINT1, SLC39A9, STOM, TRAF3, INSIG1, AP3B2, B3GAT3, CD300A, TGFBR1, HIST1H3A, PMAIP1, DSE, TMEM62, IGL@, IRF4, GSR, IRF1, EIF1AX, C9orf72, PMS2CL, C22orf37, FRMD3, IMP3, RPL17, FSD1L, APOLD1, B4GALT3, DCTN5, PPIF, CDC26, TAS2R31, RRP12, ANAPC11, GLDC, LASS4 (where if a gene name is not provided then a SEQ ID NO. is provided).

In yet other illustrative examples, a reference inSIRS IRS biomarker profile comprises at least one (e.g., 1, 2, 3, 4, 5, 6, 7, 8, 9, 10 etc.) IRS biomarker that is upregulated or overexpressed, relative to a reference ipSIRS IRS biomarker profile, non-limiting examples of which include: HIST1H2AA, IFI16, PPP1R2, CCDC125, ZRANB1, SLC11A1, GPR56, 110, KDM6B, GAB2, CYP4F3, RGS2, KIAA1257, CPM, ACPL2, PRR13, ERGIC1, PTGDR, IRS2, MPZL3, AREG, SAP30, RBP7, CASS4, FKBP5, SYNE2, KLRD1, 132, KLRF1, LOC284757, HAL, TPST1, ECHDC3, CD163, CLEC4E, DAAM2, CHI3L1, MME, OCR1 (where if a gene name is not provided then a SEQ ID NO. is provided).

In still other illustrative examples, a reference inSIRS IRS biomarker profile comprises: (1) at least one IRS biomarker that is downregulated or underexpressed relative to a reference ipSIRS IRS biomarker profile, as broadly described above and (2) at least one IRS biomarker that is upregulated or overexpressed relative to a reference ipSIRS IRS biomarker profile, as broadly described above.

In other illustrative examples, a reference ipSIRS IRS biomarker profile comprises at least one (e.g., 1, 2, 3, 4, 5, 6, 7, 8, 9, 10 etc.) IRS biomarker that is downregulated or underexpressed relative to a reference healthy condition IRS biomarker profile, representative examples of which include: GNLY, GPR56, CHI3L1, KLRF1, KLRK1, PTGDR, SH2D1B, HIST1H2AJ, FAIM3, HLA-DPB1, CAMK4, FGFBP2, KLRD1, CLC, PHOSPHO1, HIST1H4C, ITK, LRRN3, CCR3, CRIP1, IMP3, HIST1H3J, HIST1H4E, HLA-DRA, PLA2G7, GIMAP7, HLA-DPA1, CASS4, HIST1H3I, KPNA5, CENPK, SULF2, KIAA1324, HIST1H3A, CFD, C1orf128, RPIA, MRPL41, GOT2, IL5RA, PYHIN1, ITGA4, HINT1, 200, VAMP2, C15orf54, LGALS2, 199, S100B, HSP90AB1, DNAJC9, PMAIP1, CCR4, RPL17, RUNX2, NPCDR1, JUP, PMS2CL, ANAPC11, PDE3B, RASA4, CAMK1D, LY6G5B, 268, FAM118A, PPIF, B4GALT3, B3GAT3, ABCG1, IRF4, LASS4 (where if a gene name is not provided then a SEQ ID NO. is provided).

In yet other illustrative examples, a reference ipSIRS IRS biomarker profile comprises at least one (e.g., 1, 2, 3, 4, 5, 6, 7, 8, 9, 10 etc.) IRS biomarker that is upregulated or overexpressed relative to a reference healthy condition IRS biomarker profile, illustrative examples of which include: ATP6V0D1, SAP30, GAB2, KRTAP15-1, NEK6, HDHD1A, SLC39A8, HIST1H2AA, FABP2, CDS2, SRXN1, KLHL5, ACPL2, HS2ST1, HIST1H2BJ, PLIN2, ICAM1, HSPB1, PRR13, P4HA1, SLC11A1, ECHDC3, TAF13, LGALS1, TAAR1, TPX2, DLEU2, TRIM21, AGTRAP, PTGS1, LHFP, CEP97, ACTA2, SIAE, GPR65, IL1RL1, MTHFS, FAM118B, MKI67, LRRFIP1, CCRL2, GALNT2, GSTO1, LRRC70, MTRR, ANKRD28, DPH3, 110, AIG1, UBE2F, LAIR1, PCOLCE2, PLB1, CDA, JKAMP, FRMD3, ITGA2B, SEC24A, RETN, THBS1, MYL9, SPARC, RCBTB2, PLAC8, PDK4, PPP2R5A, SH3PXD2B, DAAM2, NF-E4, DDAH2, MACF1, CD63, CLEC4A, MPO, SUCNR1, EXOSC4, EFCAB2, IL1B, OR9A2, AP3B2, DYNLL1, WSB2, SLC15A2, EAF2, C1orf161, TGFBR1, ABCA1, FFAR2, SLC1A3, ATP13A3, CLU, ADM, IFI16, KCNMA1, C9orf72, GSR, DSE, PICALM, EIF2AK2, HPSE, TLR10, HSPC159, TPST1, ODZ1, STOM, HMGB2, PDGFC, CCR1, OMG, CD163, SGMS2, TREML1, FOXD4L3, C7orf53, CEACAM6, FOLR3, METTL7B, TMEM144, DNAJC13, GALNT3, B3GNT5, CLEC4E, SLC37A3, ABCA13, CD24, C11orf82, FAR2, UBE2J1, GK3P, DEFA4, LTF, ACER3, TMTC1, SMPDL3A, FKBP5, ERLIN1, PLB1, MMP9, KREMEN1, ANKRD34B, OLAH, BMX, PFKFB2, HPGD, BPI, CD274, CEACAM8, TDRD9, LCN2, TNFAIP6, C3AR1, TCN1, IL18R1, CLEC4D, TLR5, RNASE2, FCGR1A, GPR84, OLFM4, VNN1, ARG1, CD177 (where if a gene name is not provided then a SEQ ID NO. is provided).

In yet other illustrative examples, a reference ipSIRS IRS biomarker profile comprises: (1) at least one IRS biomarker that is downregulated or underexpressed relative to a reference healthy condition IRS biomarker profile, as broadly described above and (2) at least one IRS biomarker that is upregulated or overexpressed, relative to a reference healthy condition IRS biomarker profile, as broadly described above.

Yet another subset of the disclosed IRS biomarkers has been identified as being useful for assisting in distinguishing between inSIRS affected subjects and ipSIRS affected subjects. Accordingly, in some embodiments, the methods and kits are useful for determining the likelihood that inSIRS or ipSIRS is present or absent in a subject. These methods and kits generally comprise or involve: 1) providing a correlation of a reference IRS biomarker profile with the likelihood of having or not having inSIRS or ipSIRS, wherein the reference biomarker profile evaluates at least one (e.g., 1, 2, 3, 4, 5, 6, 7, 8, 9, 10 etc.) IRS biomarker selected from C11orf82, PLAC8, 132, INSIG1, CDS2, VOPP1, SLC39A9, FOXD4L3, WSB2, CD63, CD274, B3GAT3, CD300A, OCR1, JKAMP, TLR10, PTGER2, PDGFC, LGALS1, HIST1H4L, AGTRAP, AMFR, SIAE, 200, SLC15A2, SLC39A8, TGFBR1, DDAH2, HPSE, SUCNR1, MTRR, GAB2, P4HA1, HS2ST1, MRPL41, TYMS, RUNX2, GSTO1, LRRC70, HIST1H3B, RCBTB2, MPZL3, KIAA1257, AIG1, NEK6, OMG, HIST1H2BM, TDRD9, GALNT3, ATP13A3, C22orf37, SYNE2, ADM, MGST3, PDE3B, HIST1H3I, LOC284757, TRAF3, HIST1H3C, STOM, KLHL5, EXOSC4, C3AR1, KIAA0101, TNFRSF17, HAL, UBE2J1, GLT25D1, CD151, TPX2, PCOLCE2, HSPB1, EAF2, IMP3, PICALM, ACER3, IGL@, HIST1H2BJ, CASS4, ACTA2, PTGS1, KREMEN1, IRS2, TAF13, FSD1L, APOLD1, RBP7, DNAJC13, SEC24A, ERGIC1, FSD1L, TLR5, MKI67, TMEM62, CLEC4A, SDHC, C9orf72, NP, CLU, ABCA1, KIAA0746, PMAIP1, DSE, CMTM5, SMPDL3A, DNAJC9, HDHD1A, HIST1H3H, CDC26, ICAM1, LOC100128751, FAR2, CRIP1, MPZL2, FRMD3, CTSL1, METTL7B, RGS2, CLEC4E, MME, ABCA13, PRR13, HIST1H4C, RRP12, GLDC, ECHDC3, ITGA2B, C7orf53, IRF1, 268, IGK@, RNASE2, FCGR1A, UBE2F, SAP30, LAIR1, PMS2CL, SLC11A1, PLB1, AREG, PPIF, GSR, NFXL1, AP3B2, DCTN5, RPL17, PLA2G7, GALNT2, IGLV6-57, KLRF1, CHI3L1, ANKRD34B, OLFM4, 199, CPM, CCDC125, SULF2, LTF, GPR56, MACF1, PPP1R2, DYNLL1, LCN2, FFAR2, SFRS9, IGJ, FAM118B, 110, ACPL2, HIST1H3A, C7orf58, ANAPC11, HIST1H3J, IRF4, MPO, TREML1, KLRD1, GPR84, CCRL2, CAMK1D, CCR1, ZRANB1, KDM6B, TPST1, HINT1, DAAM2, PTGDR, FKBP5, CD24, HSP90AB1, HPGD, CEACAM8, DEFA4, IL1B, IFI16, CD177, KIAA1324, SRXN1, TAS2R31, CEACAM6, CD163, B4GALT3, ANKRD28, TAAR1, EIF1AX, CYP4F3, 314, HIST1H2AA, LY6G5B, LASS4 (where if a gene name is not provided then a SEQ ID NO. is provided); (2) obtaining a sample IRS biomarker profile from the subject, which evaluates for an individual IRS biomarker in the reference IRS biomarker profile a corresponding IRS biomarker; and (3) determining a likelihood of the subject having or not having inSIRS or ipSIRS based on the sample IRS biomarker profile and the reference IRS biomarker profile.

In illustrative examples of thus type, a reference inSIRS IRS biomarker profile comprises at least one (e.g., 1, 2, 3, 4, 5, 6, 7, 8, 9, 10 etc.) IRS biomarker that is downregulated or underexpressed relative to a reference ipSIRS IRS biomarker profile, non-limiting examples of which include: OLFM4, CD274, PLAC8, LCN2, IGJ, HIST1H4L, HIST1H3C, DEFA4, TDRD9, IGK@, HIST1H3B, CEACAM8, C11orf82, HIST1H2BM, LTF, HPGD, FOXD4L3, PDGFC, CD24, GPR84, CEACAM6, TLR5, SMPDL3A, CD177, HIST1H3I, C3AR1, TLR10, DNAJC9, ABCA13, ANKRD34B, RNASE2, FCGR1A, HPSE, HIST1H3H, KIAA0746, ACER3, SDHC, MTRR, WSB2, CRIP1, IGLV6-57, ATP13A3, CD63, TREML1, PLB1, MRPL41, HIST1H4C, SLC39A8, NP, NFXL1, MPO, ITGA2B, LAIR1, PTGER2, EXOSC4, TYMS, LGALS1, C7orf58, SLC15A2, CD151, ADM, KREMEN1, RCBTB2, PTGS1, AMFR, ABCA1, METTL7B, TNFRSF17, DYNLL1, HSP90AB1, CLU, MKI67, VOPP1, UBE2F, P4HA1, GLT25D1, IL1B, SUCNR1, GALNT3, AIG1, CCR1, OMG, MACF1, CLEC4A, SIAE, FAR2, C7orf53, DNAJC13, HIST1H2BJ, JKAMP, KIAA0101, GSTO1, HSPB1, DDAH2, ICAM1, UBE2J1, KLHL5, HIST1H3J, EAF2, CDS2, MGST3, FFAR2, TPX2, PICALM, HINT1, SLC39A9, SEC24A, STOM, TRAF3, INSIG1, AP3B2, PCOLCE2, B3GAT3, TAF13, CD300A, TGFBR1, HIST1H3A, PMAIP1, AGTRAP, FAM118B, DSE, NEK6, CMTM5, GALNT2, TMEM62, HS2ST1, IGL@, ACTA2, LRRC70, IRF4, GSR, IRF1, EIF1AX, C9orf72, PMS2CL, ANKRD28, CTSL1, C22orf37, FRMD3, HDHD1A, CCRL2, IMP3, RPL17, FSD1L, APOLD1, B4GALT3, FSD1L, DCTN5, PPIF, CDC26, TAS2R31, RRP12, SFRS9, TAAR1, ANAPC11, SRXN1, GLDC, LASS4 (where if a gene name is not provided then a SEQ ID NO. is provided).

In other illustrative examples, a reference inSIRS IRS biomarker profile comprises at least one (e.g., 1, 2, 3, 4, 5, 6, 7, 8, 9, 10 etc.) IRS biomarker that is upregulated or overexpressed, relative to a reference ipSIRS IRS biomarker profile, representative examples of which include: HIST1H2AA, LY6G5B, 268, IFI16, PPP1R2, CCDC125, ZRANB1, LOC100128751, SLC11A1, GPR56, RUNX2, 110, KDM6B, GAB2, 199, CYP4F3, RGS2, PDE3B, KIAA1257, CAMK1D, CPM, ACPL2, PRR13, ERGIC1, PTGDR, IRS2, MPZL3, MPZL2, AREG, SAP30, RBP7, CASS4, FKBP5, SYNE2, SULF2, KLRD1, 132, KLRF1, 314, LOC284757, HAL, TPST1, ECHDC3, CD163, KIAA1324, PLA2G7, CLEC4E, DAAM2, 200, CHI3L1, MME, OCR1 (where if a gene name is not provided then a SEQ ID NO. is provided).

In still other illustrative examples, an inSIRS IRS biomarker profile comprises: (1) at least one IRS biomarker that is downregulated or underexpressed relative to a reference ipSIRS IRS biomarker profile, as broadly described above and (2) at least one IRS biomarker that is upregulated or overexpressed relative to a reference ipSIRS IRS biomarker profile, as broadly described above.

Still another subset of the disclosed IRS biomarkers has been identified as being useful for assisting in distinguishing between subjects with different stages of ipSIRS selected from mild sepsis, severe sepsis and septic shock. Accordingly, in some embodiments, the methods and kits are useful for determining the likelihood that a stage of ipSIRS selected from mild sepsis, severe sepsis and septic shock is present or absent in a subject. These methods and kits generally comprise or involve: 1) providing a correlation of a reference IRS biomarker profile with the likelihood of having or not having the stage of ipSIRS, wherein the reference biomarker IRS biomarker profile evaluates at least one (e.g., 1, 2, 3, 4, 5, 6, 7, 8, 9, 10 etc.) IRS biomarker selected from PLEKHA3, PLEKHF2, 232, SFRS9, ZNF587, KPNA5, LOC284757, GPR65, VAMP2, SLC1A3, ITK, ATF7, ZNF28, AIF1, MINPP1, GIMAP7, MKI67, IRF4, TSHZ2, HLA-DPB1, EFCAB2, POLE2, FAIM3, 110, CAMK4, TRIM21, IF144, CENPK, ATP5L, GPR56, HLA-DPA1, C4orf3, GSR, GNLY, RFESD, BPI, HIST1H2AA, NF-E4, CALM2, EIF1AX, E2F6, ARL17P1, TLR5, SH3PXD2B, FAM118A, RETN, PMAIP1, DNAJC9, PCOLCE2, TPX2, BMX, LRRFIP1, DLEU2, JKAMP, JUP, ABCG1, SLC39A9, B3GNT5, ACER3, LRRC70, NPCDR1, TYMS, HLA-DRA, TDRD9, FSD1L, FAR2, C7orf53, PPP1R2, SGMS2, EXOSC4, TGFBR1, CD24, TCN1, TAF13, AP3B2, CD63, SLC15A2, IL18R1, ATP6V0D1, SON, HSP90AB1, CEACAM8, SMPDL3A, IMP3, SEC24A, PICALM, 199, CEACAM6, CYP4F3, OLAH, ECHDC3, ODZ1, KIAA0746, KIAA1324, HINT1, VNN1, C22orf37, FSD1L, FOLR3, IL1RL1, OMG, MTHFS, OLFM4, S100B, ITGA4, KLRD1, SLC39A8, KLHL5, KLRK1, MPO, PPIF, GOT2, LRRN3, HIST1H2AJ, CLU, LCN2, 132, CEP97, KLRF1, FBXL13, HIST1H3B, ANKRD34B, RPIA, HPGD, HIST2H2BF, GK3P (where if a gene name is not provided then a SEQ ID NO. is provided).; (2) obtaining a sample IRS biomarker profile from the subject, which evaluates for an individual IRS biomarker in the reference IRS biomarker profile a corresponding IRS biomarker; and (3) determining a likelihood of the subject having or not having the stage of ipSIRS based on the sample IRS biomarker profile and the reference IRS biomarker profile.

In illustrative examples of this type, a reference mild sepsis IRS biomarker profile comprises at least one (e.g., 1, 2, 3, 4, 5, 6, 7, 8, 9, 10 etc.) IRS biomarker that is downregulated or underexpressed relative to a reference severe sepsis IRS biomarker profile, illustrative examples of which include: OLFM4, CEACAM8, TCN1, BPI, LCN2, CD24, CEACAM6, NF-E4, HIST1H3B, MKI67, OLAH, TYMS, DNAJC9, MPO, LOC284757, ODZ1, HSP90AB1, VNN1, ANKRD34B, FBXL13, TSHZ2, KIAA0746, FOLR3, GSR, IRF4, LRRN3, TPX2, SFRS9, C7orf53, CYP4F3, IL1RL1, TDRD9, IL18R1, BMX, NPCDR1, GOT2, ATF7, CEP97, ITK, SEC24A, KIAA1324, FAM118A, 132, SMPDL3A, CD63, ABCG1, TLR5, CAMK4, CLU, SLC39A9, GK3P, LRRFIP1, AP3B2, SLC15A2, PICALM, HIST1H2AA, SGMS2, OMG, REIN, FAIM3, EXOSC4, SH3PXD2B, FAR2, 199, C4orf3, PCOLCE2 (where if a gene name is not provided then a SEQ ID NO. is provided).

In other illustrative examples, a reference mild sepsis IRS biomarker profile comprises at least one (e.g., 1, 2, 3, 4, 5, 6, 7, 8, 9, 10 etc.) IRS biomarker that is upregulated or overexpressed, relative to a reference severe sepsis IRS biomarker profile, non-limiting examples of which include: JUP, SLC1A3, ECHDC3, IMP3, SLC39A8, MTHFS, TGFBR1, FSD1L, HIST2H2BF, HPGD, FSD1L, PPP1R2, B3GNT5, C22orf37, ACER3, GIMAP7, ATP6V0D1, KLHL5, PPIF, KLRK1, HINT1, GPR56, LRRC70, S100B, 110, SON, ZNF587, JKAMP, ITGA4, HLA-DRA, ZNF28, TRIM21, TAF13, HLA-DPA1, ARL17P1, KLRF1, PMAIP1, RPIA, ATP5L, VAMP2, E2F6, KLRD1, EIF1AX, PLEKHA3, GPR65, CENPK, CALM2, GNLY, DLEU2, HLA-DPB1, AIF1, KPNA5, EFCAB2, PLEKHF2, 232, RFESD, MINPP1, HIST1H2AJ, POLE2, IF144 (where if a gene name is not provided then a SEQ ID NO. is provided).

In still other illustrative examples, a reference mild sepsis IRS biomarker profile comprises: (1) at least one IRS biomarker that is downregulated or underexpressed relative to a reference severe sepsis IRS biomarker profile, as broadly described above and (2) at least one IRS biomarker that is upregulated or overexpressed relative to a reference severe sepsis IRS biomarker profile, as broadly described above.

In other illustrative examples, a reference severe sepsis IRS biomarker profile comprises at least one (e.g., 1, 2, 3, 4, 5, 6, 7, 8, 9, 10 etc.) IRS biomarker that is downregulated or underexpressed relative to a reference septic shock IRS biomarker profile, non-limiting examples of which include: HPGD, SLC1A3, B3GNT5, SMPDL3A, ACER3, RETN, IL18R1, FSD1L, SH3PXD2B, SLC39A8, EXOSC4, FSD1L, AP3B2, ECHDC3, GPR65, TDRD9, BMX, PCOLCE2, PLEKHF2, SGMS2, RPIA, GK3P, FAR2, LRRC70, TGFBR1, MTHFS, C4orf3, TLR5, OLAH, TAF13, JKAMP, POLE2, PICALM, RFESD, ANKRD34B, OMG, VNN1, EIF1AX, KLHL5, SON, LRRFIP1, HIST1H2AJ, AIF1, SLC15A2, CALM2, CD63, HIST1H2AA, MINPP1, S100B, DLEU2, PLEKHA3, ODZ1, FOLR3, 232, EFCAB2, SEC24A, E2F6, SLC39A9, ZNF28, KLRF1, ATP6V0D1, IL1RL1, PPIF (where if a gene name is not provided then a SEQ ID NO. is provided).

In yet other illustrative examples, a reference severe sepsis IRS biomarker profile comprises at least one (e.g., 1, 2, 3, 4, 5, 6, 7, 8, 9, 10 etc.) IRS biomarker that is upregulated or overexpressed, relative to a reference septic shock IRS biomarker profile, representative examples of which include: LCN2, CENPK, C22orf37, PMAIP1, KPNA5, ATP5L, TCN1, 132, CD24, ITGA4, KLRD1, SFRS9, TRIM21, VAMP2, GSR, LOC284757, PPP1R2, HINT1, 110, IMP3, C7orf53, ATF7, KIAA0746, GNLY, HLA-DRA, IF144, ZNF587, CEP97, GPR56, OLFM4, CLU, KLRK1, GOT2, JUP, HLA-DPA1, NPCDR1, TPX2, HIST2H2BF, HLA-DPB1, FAM118A, ABCG1, MKI67, MPO, LRRN3, FBXL13, ARL17P1, CEACAM8, TSHZ2, 199, BPI, HSP90AB1, CYP4F3, TYMS, GIMAP7, DNAJC9, NF-E4, IRF4, HIST1H3B, CAMK4, FAIM3, CEACAM6, ITK, KIAA1324 (where if a gene name is not provided then a SEQ ID NO. is provided).

In still other illustrative examples, a reference severe sepsis IRS biomarker profile comprises: (1) at least one IRS biomarker that is downregulated or underexpressed relative to a reference septic shock IRS biomarker profile, as broadly described above and (2) at least one IRS biomarker that is upregulated or overexpressed relative to a reference septic shock IRS biomarker profile, as broadly described above.

In other illustrative examples, a reference septic shock IRS biomarker profile comprises at least one (e.g., 1, 2, 3, 4, 5, 6, 7, 8, 9, 10 etc.) IRS biomarker that is downregulated or underexpressed relative to a reference mild sepsis IRS biomarker profile, representative examples of which include: IF144, HLA-DPB1, ARL17P1, HIST1H2AJ, MINPP1, GNLY, GIMAP7, HLA-DPA1, POLE2, 232, KPNA5, GPR56, HLA-DRA, ZNF587, KLRK1, RFESD, VAMP2, CENPK, KIAA1324, KLRD1, EFCAB2, ATP5L, 110, ITK, FAIM3, TRIM21, PMAIP1, HIST2H2BF, HINT1, DLEU2, AIF1, E2F6, ITGA4, KLRF1, CALM2, PLEKHA3, PPP1R2, CAMK4, 199, ZNF28, PLEKHF2, JUP, EIF1AX, PPIF, IMP3, C22orf37, ATP6V0D1, S100B, SON, GPR65, ABCG1, TAF13, FAM118A, RPIA, KLHL5, JKAMP, IRF4, CLU, CYP4F3, LRRC70 (where if a gene name is not provided then a SEQ ID NO. is provided).

In yet other illustrative examples, a reference septic shock IRS biomarker profile comprises at least one (e.g., 1, 2, 3, 4, 5, 6, 7, 8, 9, 10 etc.) IRS biomarker that is upregulated or overexpressed, relative to a reference mild sepsis IRS biomarker profile, illustrative examples of which include: GOT2, NPCDR1, CEP97, LRRN3, DNAJC9, TSHZ2, HSP90AB1, TYMS, HIST1H3B, ATF7, FBXL13, TPX2, TGFBR1, MPO, 132, NF-E4, MTHFS, CEACAM6, C7orf53, FSD1L, FSD1L, SLC39A9, MKI67, KIAA0746, HIST1H2AA, ACER3, ECHDC3, SLC15A2, SLC39A8, SEC24A, SFRS9, LRRFIP1, OMG, GSR, C4orf3, CD63, PICALM, LOC284757, FAR2, PCOLCE2, IL1RL1, B3GNT5, SGMS2, TLR5, EXOSC4, SH3PXD2B, GK3P, AP3B2, FOLR3, BPI, RETN, ODZ1, CEACAM8, BMX, HPGD, VNN1, ANKRD34B, SLC1A3, TDRD9, SMPDL3A, CD24, IL18R1, OLAH, LCN2, TCN1, OLFM4 (where if a gene name is not provided then a SEQ ID NO. is provided).

In yet other illustrative examples, a reference septic shock IRS biomarker profile comprises: (1) at least one IRS biomarker that is downregulated or underexpressed relative to a reference mild sepsis IRS biomarker profile, as broadly described above and (2) at least one IRS biomarker that is upregulated or overexpressed relative to a reference mild sepsis IRS biomarker profile, as broadly described above.

In some embodiments, individual IRS biomarkers as broadly described above and elsewhere herein are selected from the group consisting of: (a) a polynucleotide expression product comprising a nucleotide sequence that shares at least 70% (or at least 71% to at least 99% and all integer percentages in between) sequence identity with the sequence set forth in any one of SEQ ID NO: 1-319, or a complement thereof; (b) a polynucleotide expression product comprising a nucleotide sequence that encodes a polypeptide comprising the amino acid sequence set forth in any one of SEQ ID NO: 320-619; (c) a polynucleotide expression product comprising a nucleotide sequence that encodes a polypeptide that shares at least 70% (or at least 71% to at least 99% and all integer percentages in between) sequence similarity or identity with at least a portion of the sequence set forth in SEQ ID NO: 320-619; (d) a polynucleotide expression product comprising a nucleotide sequence that hybridizes to the sequence of (a), (b), (c) or a complement thereof, under medium or high stringency conditions; (e) a polypeptide expression product comprising the amino acid sequence set forth in any one of SEQ ID NO: 320-619; and (f) a polypeptide expression product comprising an amino acid sequence that shares at least 70% (or at least 71% to at least 99% and all integer percentages in between) sequence similarity or identity with the sequence set forth in any one of SEQ ID NO: 320-619.

In some embodiments, the methods and kits comprise or involve: (1) measuring in the biological sample the level of an expression product of at least one (e.g., 1, 2, 3, 4, 5, 6, 7, 8, 9, 10 or more) IRS biomarker gene and (2) comparing the measured level or functional activity of each expression product to the level or functional activity of a corresponding expression product in a reference sample.

The present invention also extends to the management of inSIRS, ipSIRS or particular stages of ipSIRS, or prevention of further progression of inSIRS, ipSIRS or particular stages of ipSIRS (e.g., mild sepsis, severe sepsis and septic shock), or assessment of the efficacy of therapies in subjects following positive diagnosis for the presence of inSIRS, ipSIRS or particular stage of ipSIRS (e.g., mild sepsis, severe sepsis and septic shock) in a subject. The management of inSIRS or ipSIRS conditions is generally highly intensive and can include identification and amelioration of the underlying cause and aggressive use of therapeutic compounds such as, vasoactive compounds, antibiotics, steroids, antibodies to endotoxin, anti tumour necrosis factor agents, recombinant protein C. In addition, palliative therapies as described for example in Cohen and Glauser (1991, Lancet 338: 736-739) aimed at restoring and protecting organ function can be used such as intravenous fluids and oxygen and tight glycemic control. Therapies for ipSIRS are reviewed in Healy (2002, Ann. Pharmacother. 36(4): 648-54) and Brindley (2005, CJEM. 7(4): 227) and Jenkins (2006, J Hosp Med. 1(5): 285-295).

Typically, the therapeutic agents will be administered in pharmaceutical (or veterinary) compositions together with a pharmaceutically acceptable carrier and in an effective amount to achieve their intended purpose. The dose of active compounds administered to a subject should be sufficient to achieve a beneficial response in the subject over time such as a reduction in, or relief from, the symptoms of inSIRS, ipSIRS or particular stages of ipSIRS. The quantity of the pharmaceutically active compounds(s) to be administered may depend on the subject to be treated inclusive of the age, sex, weight and general health condition thereof. In this regard, precise amounts of the active compound(s) for administration will depend on the judgment of the practitioner. In determining the effective amount of the active compound(s) to be administered in the treatment or prevention of inSIRS, ipSIRS or particular stages of ipSIRS, the medical practitioner or veterinarian may evaluate severity of any symptom associated with the presence of inSIRS, ipSIRS or particular stages of ipSIRS including, inflammation, blood pressure anomaly, tachycardia, tachypnea fever, chills, vomiting, diarrhoea, skin rash, headaches, confusion, muscle aches, seizures. In any event, those of skill in the art may readily determine suitable dosages of the therapeutic agents and suitable treatment regimens without undue experimentation.

The therapeutic agents may be administered in concert with adjunctive (palliative) therapies to increase oxygen supply to major organs, increase blood flow to major organs and/or to reduce the inflammatory response. Illustrative examples of such adjunctive therapies include non steroidal-anti inflammatory drugs (NSAIDs), intravenous saline and oxygen.

Thus, the present invention contemplates the use of the methods and kits described above and elsewhere herein in methods for treating, preventing or inhibiting the development of inSIRS, ipSIRS or a particular stage of ipSIRS (e.g., mild sepsis, severe sepsis and septic shock) in a subject. These methods generally comprise (1) correlating a reference IRS biomarker profile with the presence or absence of a condition selected from a healthy condition, SIRS, inSIRS, ipSIRS, or a particular stage of ipSIRS, wherein the reference IRS biomarker profile evaluates at least one (e.g., 1, 2, 3, 4, 5, 6, 7, 8, 9, 10 etc.) IRS biomarker; (2) obtaining an IRS biomarker profile of a sample (i.e., "a sample IRS biomarker profile") from a subject, wherein the sample IRS biomarker profile evaluates for an individual IRS biomarker in the reference IRS biomarker profile a corresponding IRS biomarker; (3) determining a likelihood of the subject having or not having the condition based on the sample IRS biomarker profile and the reference IRS biomarker profile, and administering to the subject, on the basis that the subject has an increased likelihood of having inSIRS, an effective amount of an agent that treats or ameliorates the symptoms or reverses or inhibits the development of inSIRS, or administering to the subject, on the basis that the subject has an increased likelihood of having ipSIRS or a particular stage of ipSIRS, an effective amount of an agent that treats or ameliorates the symptoms or reverses or inhibits the development of ipSIRS or the particular stage of ipSIRS.

In some embodiments the methods and kits of the present invention are used for monitoring, treatment and management of conditions that can lead to inSIRS or ipSIRS, illustrative examples of which include retained placenta, meningitis, endometriosis, shock, toxic shock (i.e., sequelae to tampon use), gastroenteritis, appendicitis, ulcerative colitis, Crohn's disease, inflammatory bowel disease, acid gut syndrome, liver failure and cirrhosis, failure of colostrum transfer in neonates, ischemia (in any organ), bacteraemia, infections within body cavities such as the peritoneal, pericardial, thecal, and pleural cavities, burns, severe wounds, excessive exercise or stress, haemodialysis, conditions involving intolerable pain (e.g., pancreatitis, kidney stones), surgical operations, and non-healing lesions. In these embodiments, the methods or kits of the present invention are typically used at a frequency that is effective to monitor the early development of inSIRS, ipSIRS or particular stages of ipSIRS, to thereby enable early therapeutic intervention and treatment of that condition. In illustrative examples, the diagnostic methods or kits are used at least at 1, 2, 3, 4,5, 6, 7, 8, 9, 10, 11, 12, 13, 14, 15, 16, 17, 18, 19, 20, 21, 22, 23 or 24 hour intervals or at least 1, 2, 3, 4, 5 or 6 day intervals, or at least weekly, fortnightly or monthly. Accordingly, the present invention encompasses the use of the methods and kits of the present invention for early diagnosis of inSIRS, ipSIRS or particular stages of ipSIRS.

The term "early diagnosis" as used herein with "early detection" refers to specific screening/monitoring processes that allow detection and evaluation of inSIRS, ipSIRS or particular stages of ipSIRS at an early point in disease development and/or progression. For example, since both inSIRS and ipSIRS patients present with similar clinical signs, early detection of ipSIRS can be achieved through a plurality of evaluations of patients with inSIRS to detect a transition to ipSIRS.

The present invention can be practiced in the field of predictive medicine for the purposes of diagnosis or monitoring the presence or development of a condition selected from inSIRS, ipSIRS or a particular stage of ipSIRS in a subject, and/or monitoring response to therapy efficacy.

The IRS biomarker profile further enables determination of endpoints in pharmacotranslational studies. For example, clinical trials can take many months or even years to establish the pharmacological parameters for a medicament to be used in treating or preventing inSIRS, ipSIRS or a particular stage of ipSIRS (e.g., mild sepsis, severe sepsis and septic shock). However, these parameters may be associated with an IRS biomarker profile associated with a health state (e.g., a healthy condition). Hence, the clinical trial can be expedited by selecting a treatment regimen (e.g., medicament and pharmaceutical parameters), which results in an IRS biomarker profile associated with the desired health state (e.g., healthy condition). This may be determined for example by (1) providing a correlation of a reference IRS biomarker profile with the likelihood of having the healthy condition; (2) obtaining a corresponding IRS biomarker profile of a subject having inSIRS, ipSIRS or a particular stage of ipSIRS after treatment with a treatment regimen, wherein a similarity of the subject's IRS biomarker profile after treatment to the reference IRS biomarker profile indicates the likelihood that the treatment regimen is effective for changing the health status of the subject to the desired health state (e.g., healthy condition). This aspect of the present invention advantageously provides methods of monitoring the efficacy of a particular treatment regimen in a subject (for example, in the context of a clinical trial) already diagnosed with a condition selected from inSIRS, ipSIRS or a particular stage of ipSIRS. These methods take advantage of IRS biomarkers that correlate with treatment efficacy, for example, to determine whether the IRS biomarker profile of a subject undergoing treatment partially or completely normalizes during the course of or following therapy or otherwise shows changes associated with responsiveness to the therapy.

The IRS biomarker profile further enables stratification of patients prior to enrolment in pharmacotranslational studies. For example, a clinical trial can be expedited by selecting a priori patients with a particular IRS biomarker profile that would most benefit from a particular treatment regimen (e.g., medicament and pharmaceutical parameters). For instance, patient enrolment into a clinical trial testing the efficacy of a new antibiotic would best include patients with an IRS biomarker profile that indicated that they had ipSIRS rather than inSIRS, and as such the selected patients would most likely benefit from the new therapy. Further, and by example, patient enrolment into a clinical trial testing the efficacy of a new inotrope would best include patients with an IRS biomarker profile that indicated that they had the shock stage of ipSIRS rather than inSIRS or other stage of ipSIRS, and as such the selected patients would most likely benefit from the new therapy.

As used herein, the term "treatment regimen" refers to prophylactic and/or therapeutic (i.e., after onset of a specified condition) treatments, unless the context specifically indicates otherwise. The term "treatment regimen" encompasses natural substances and pharmaceutical agents (i.e., "drugs") as well as any other treatment regimen including but not limited to dietary treatments, physical therapy or exercise regimens, surgical interventions, and combinations thereof.

Thus, the invention provides methods of correlating a reference IRS biomarker profile with an effective treatment regimen for a condition selected from inSIRS, ipSIRS or a particular stage of ipSIRS (e.g., mild sepsis, severe sepsis and septic shock), wherein the reference IRS biomarker profile evaluates at least one (e.g., 1, 2, 3, 4, 5, 6, 7, 8, 9, 10, etc.) IRS biomarker. These methods generally comprise: (a) determining a sample IRS biomarker profile from a subject with the condition prior to treatment (i.e., baseline), wherein the sample IRS biomarker profile evaluates for an individual IRS biomarker in the reference IRS biomarker profile a corresponding IRS biomarker; and correlating the sample IRS biomarker profile with a treatment regimen that is effective for treating that condition.

The invention further provides methods of determining whether a treatment regimen is effective for treating a subject with a condition selected from inSIRS, ipSIRS or a particular stage of ipSIRS (e.g., mild sepsis, severe sepsis and septic shock). These methods generally comprise: (a) correlating a reference biomarker profile prior to treatment (i.e., baseline) with an effective treatment regimen for the condition, wherein the reference IRS biomarker profile evaluates at least one (e.g., 1, 2, 3, 4, 5, 6, 7, 8, 9, 10, etc.) IRS biomarker; and (b) obtaining a sample IRS biomarker profile from the subject after treatment, wherein the sample IRS biomarker profile evaluates for an individual IRS biomarker in the reference IRS biomarker profile a corresponding IRS biomarker, and wherein the sample IRS biomarker profile after treatment indicates whether the treatment regimen is effective for treating the condition in the subject.

The invention can also be practiced to evaluate whether a subject is responding (i.e., a positive response) or not responding (i.e., a negative response) to a treatment regimen. This aspect of the invention provides methods of correlating an IRS biomarker profile with a positive and/or negative response to a treatment regimen. These methods generally comprise: (a) obtaining an IRS biomarker profile from a subject with a condition selected from inSIRS, ipSIRS or a particular stage of ipSIRS (e.g., mild sepsis, severe sepsis and septic shock) following commencement of the treatment regimen, wherein the IRS biomarker profile evaluates at least one (e.g., 1, 2, 3, 4, 5, 6, 7, 8, 9, 10, etc.) IRS biomarker; and (b) correlating the IRS biomarker profile from the subject with a positive and/or negative response to the treatment regimen.

The invention also provides methods of determining a positive and/or negative response to a treatment regimen by a subject with a condition selected from inSIRS, ipSIRS or a particular stage of ipSIRS (e.g., mild sepsis, severe sepsis and septic shock). These methods generally comprise: (a) correlating a reference IRS biomarker profile with a positive and/or negative response to the treatment regimen, wherein the reference IRS biomarker profile evaluates at least one (e.g., 1, 2, 3, 4, 5, 6, 7, 8, 9, 10, etc.) IRS biomarker; and (b) determining a sample IRS biomarker profile from the subject, wherein the subject's sample IRS biomarker profile evaluates for an individual IRS biomarker in the reference IRS biomarker profile a corresponding IRS biomarker and indicates whether the subject is responding to the treatment regimen.

In some embodiments, the methods further comprise determining a first sample IRS biomarker profile from the subject prior to commencing the treatment regimen (i.e., a baseline profile), wherein the first sample IRS biomarker profile evaluates at least one (e.g., 1, 2, 3, 4, 5, 6, 7, 8, 9, 10, etc.) IRS biomarker; and comparing the first sample IRS biomarker profile with a second sample IRS biomarker profile from the subject after commencement of the treatment regimen, wherein the second sample IRS biomarker profile evaluates for an individual IRS biomarker in the first sample IRS biomarker profile a corresponding IRS biomarker.

This aspect of the invention can be practiced to identify responders or non-responders relatively early in the treatment process, i.e., before clinical manifestations of efficacy. In this way, the treatment regimen can optionally be discontinued, a different treatment protocol can be implemented and/or supplemental therapy can be administered. Thus, in some embodiments, a sample IRS biomarker profile is obtained within about 2 hours, 4 hours, 6 hours, 12 hours, 1 day, 2 days, 3 days, 4 days, 5 days, 1 week, 2 weeks, 3 weeks, 4 weeks, 6 weeks, 8 weeks, 10 weeks, 12 weeks, 4 months, six months or longer of commencing therapy.

In order that the invention may be readily understood and put into practical effect, particular preferred embodiments will now be described by way of the following non-limiting examples.

EXAMPLES

Example 1

Monitoring Severity of IPSIRS in Patients in Intensive Care

Patients admitted to intensive care (ICU) often have ipSIRS, or develop ipSIRS during their ICU stay. The ultimate aim of intensive care is to ensure the patient survives and is discharged to a general ward in the minimum time. Patients in intensive care with diagnosed ipSIRS are usually administered a number of therapeutic compounds—many of which have opposing actions on the immune system and many of which could be counterproductive depending on the severity of ipSIRS (mild sepsis, severe sepsis, septic shock). Monitoring intensive care patients on a regular basis with biomarkers of the present invention will allow medical practitioners to determine the stage of ipSIRS and hence choice of therapies and patient management procedures, and ultimately response to therapy. Information provided by these biomarkers disclosed herein ("the IRS biomarkers") will therefore allow medical practitioners to tailor and modify therapies to ensure patients survive and spend less time in intensive care. Less time in intensive care leads to considerable savings in medical expenses including through less occupancy time and appropriate use and timing of medications. Practical examples of the use of the IRS biomarkers in Tables 1-6 are described.

Tables 1, 2 and 3 list those top 10 IRS biomarkers (by example) in ascending order of p value (less than 0.05) when comparing the clinical groups of mild sepsis, severe sepsis and septic shock (severe versus mild, shock versus mild and shock versus severe—the appropriate column is filled grey for each group in respective tables). In this and the following examples significance is defined when a p value is less than 0.05. P values were determined by adjusted t-test (Benjamini & Hochberg, 1995) in the case of healthy vs. other and inSIRS vs. ipSIRS, and by Tukey's Honestly Significant Difference for analysis of variance (ANOVA) for the mild/severe/shock comparisons. For the groups severe versus mild, shock versus mild and shock versus severe there were 72, 120 and 47 biomarkers respectively with a p value less than 0.05.

Tables 4, 5 and 6 list those top 10 biomarkers (by example) in descending order of Area Under Curve (AUC) value when comparing the clinical groups of mild sepsis, severe sepsis and septic shock (severe versus mild, shock versus mild and shock versus severe—the appropriate column is filled grey for each group in respective tables). For the groups severe versus mild, shock versus mild and shock versus severe there were 34, 17 and 2 biomarkers respectively with an AUC greater than 0.8 (a nominal cut-off above which would be considered to be good).

In each of Tables 1-6 a SEQ ID NO. is provided for each IRS biomarker (IRS biomarker polynucleotides range from SEQ ID NO. 1-319, IRS biomarker polypeptides range from SEQ ID No. 320-619), along with a database identification tag (e.g. NM_), a gene name (Gene Name) if there is one, and either; mean expression values for healthy (HC), inSIRS, mild sepsis, severe sepsis and septic shock, and p values for HC vs. all other groups, inSIRS vs. ipSIRS, mild sepsis versus severe sepsis, mild sepsis versus septic shock and septic shock versus severe sepsis, or AUC values for HC vs. Sick, HC vs. inSIRS, HC vs. ipSIRS, inSIRS vs. ipSIRS, Mild Sepsis versus Severe Sepsis, Mild Sepsis versus Septic Shock and Septic Shock versus Severe Sepsis. Such biomarkers have clinical utility in determining ipSIRS severity based on these groups. By example, in Table 1, Severe versus Mild p Value, it can be seen that the gene PLEKHA3 has a significant p value for both Severe versus Mild and Shock versus Mild and therefore has utility in separating mild sepsis from both severe sepsis and septic shock. In Table 2, Severe versus Mild Area Under Curve, it can be seen that the gene PLEKHA3 has an AUC of 0.8748 and therefore has most utility in separating mild sepsis from severe sepsis. It can be seen that the p value for PLEKHA3 for separating septic shock from severe sepsis is not significant (>0.05) and therefore this biomarker has no utility in separating these two groups. From the columns in the table containing mean expression data it can be seen that PLEKHA3 is down-regulated in both severe sepsis (6.689) and septic shock (6.825) compared to mild sepsis (7.281) (also see FIG. 1).

Figure 2:
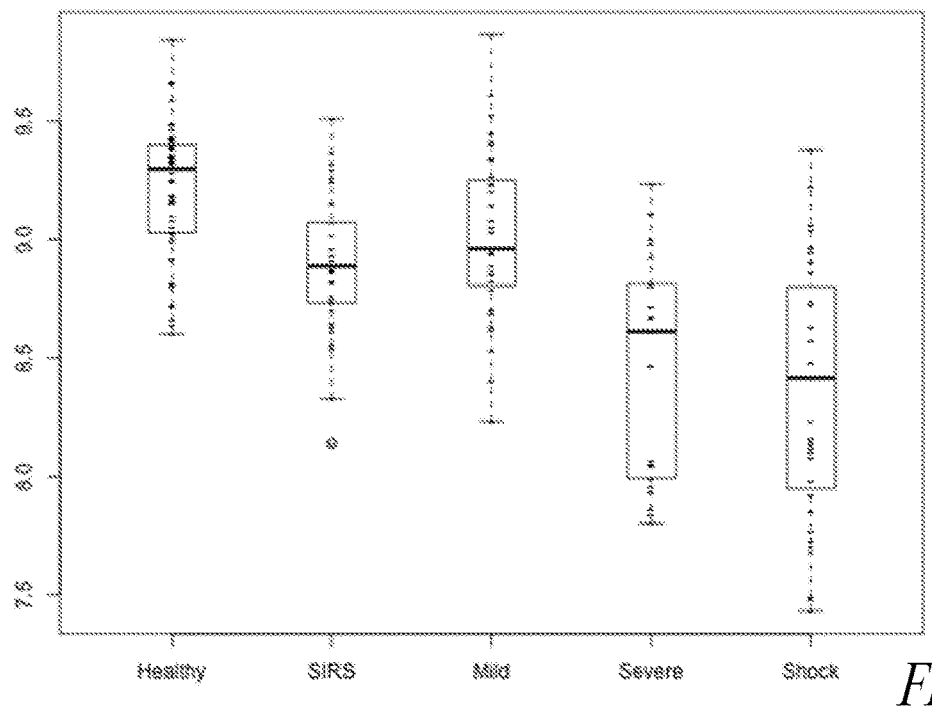
FIG. 2 shows a box and whiskers plot of VAMP2 gene expression for healthy subjects and subjects with SIRS, mild sepsis, severe sepsis.

Further and by example in Table 3, Shock vs. Mild p Value, it can be seen that the biomarker VAMP2 has utility in separating mild sepsis from septic shock but also from severe sepsis. VAMP2 does not have utility in separating septic shock from severe sepsis (p=0.708038) but does have further utility in separating healthy from other groups. From the mean expression columns it can also be seen that the expression level of VAMP2 is downregulated in both severe sepsis (8.454) and septic shock (8.353) compared to mild sepsis (9.016) (see also FIG. 2). In Table 4, Shock vs. Mild Area Under Curve, it can be seen that VAMP2 has an AUC of 0.8342.

Figure 3:
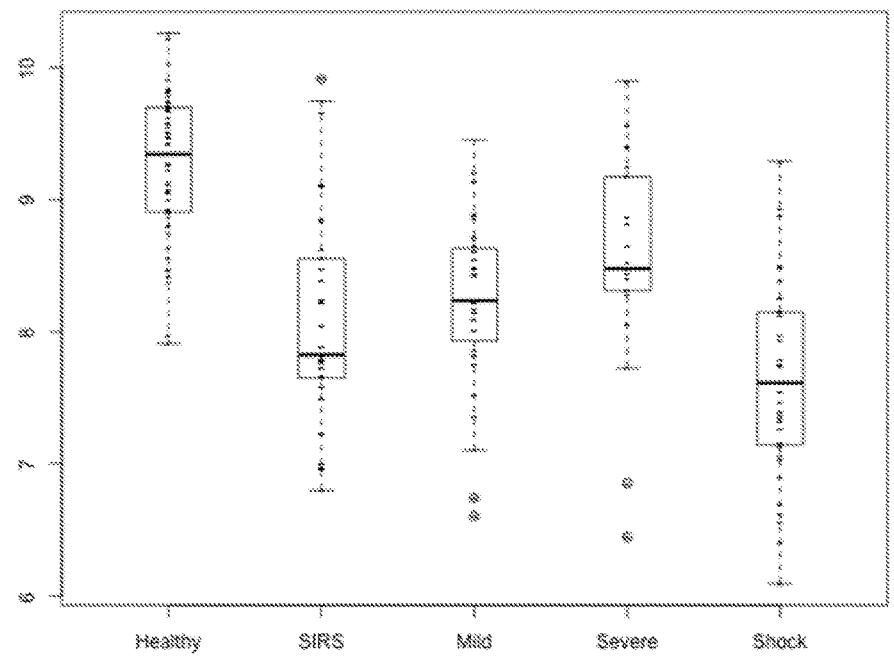
FIG. 3 shows a box and whiskers plot of ITK gene expression for healthy subjects and subjects with SIRS, mild sepsis, severe sepsis.

Further and by example in Table 5, Shock versus Severe p Value, it can be seen that the biomarker ITK has utility in separating Shock versus Severe Sepsis and Mild Sepsis, and healthy from other groups but no utility in separating Severe Sepsis and Mild Sepsis. From the mean expression values for ITK it can be seen that it is comparatively downregulated in Septic Shock compared to both Severe and Mild Sepsis (see also FIG. 3). In Table 6, Shock versus Severe Area Under Curve, it can be seen that ITK has an AUC of 0.8054.

TABLE 1

Severe versus Mild p Value

| SEQ ID Number | Database ID | Gene Name | HC Mean | inSIRS Mean | Mild Mean | Severe Mean | Shock Mean | pval. HC.vs. Other | pval. inSIRS. vs.ipSIRS | pval Severe.vs. Mild | pval Shock.vs. Mild | pval Shock.vs. Severe |
|---|---|---|---|---|---|---|---|---|---|---|---|---|
| 285 | NM_019091 | PLEKHA3 | 7.058 | 6.910 | 7.281 | 6.689 | 6.825 | 1.000000 | 1.000000 | 0.000001 | 0.000011 | 0.409707 |
| 587 | NM_019091 | PLEKHA3 | 7.058 | 6.910 | 7.281 | 6.689 | 6.825 | 1.000000 | 1.000000 | 0.000001 | 0.000011 | 0.409707 |
| 232 | gi|4250459 | NA | 6.389 | 5.970 | 6.875 | 5.976 | 6.059 | 1.000000 | 0.638753 | 0.000001 | 0.000000 | 0.869569 |
|  | gi|4250459 | NA | 6.389 | 5.970 | 6.875 | 5.976 | 6.059 | 1.000000 | 0.638753 | 0.000001 | 0.000000 | 0.869569 |
| 195 | NM_004897 | MINPP1 | 8.212 | 7.697 | 8.228 | 7.151 | 7.317 | 0.006705 | 1.000000 | 0.000005 | 0.000008 | 0.707929 |
| 504 | NM_004897 | MINPP1 | 8.212 | 7.697 | 8.228 | 7.151 | 7.317 | 0.006705 | 1.000000 | 0.000005 | 0.000008 | 0.707929 |
| 288 | NM_024613 | PLEKHF2 | 7.432 | 7.660 | 8.044 | 7.255 | 7.671 | 0.789194 | 1.000000 | 0.000012 | 0.023331 | 0.029137 |
| 590 | NM_024613 | PLEKHF2 | 7.432 | 7.660 | 8.044 | 7.255 | 7.671 | 0.789194 | 1.000000 | 0.000012 | 0.023331 | 0.029137 |
| 190 | NM_176818 | SFRS9 | 9.739 | 9.666 | 9.715 | 10.226 | 10.128 | 1.000000 | 0.000618 | 0.000018 | 0.000064 | 0.627141 |
| 499 | NM_176818 | SFRS9 | 9.739 | 9.666 | 9.715 | 10.226 | 10.128 | 1.000000 | 0.000618 | 0.000018 | 0.000064 | 0.627141 |
| 207 | NR_002612 | DLEU2 | 6.549 | 6.894 | 7.347 | 6.699 | 6.850 | 0.000171 | 1.000000 | 0.000019 | 0.000152 | 0.504529 |
|  | NR_002612 | DLEU2 | 6.549 | 6.894 | 7.347 | 6.699 | 6.850 | 0.000171 | 1.000000 | 0.000019 | 0.000152 | 0.504529 |
| 197 | NM_006969 | ZNF28 | 4.936 | 4.511 | 5.008 | 4.554 | 4.612 | 0.021118 | 0.027741 | 0.000020 | 0.000018 | 0.814925 |
| 506 | NM_006969 | ZNF28 | 4.936 | 4.511 | 5.008 | 4.554 | 4.612 | 0.021118 | 0.027741 | 0.000020 | 0.000018 | 0.814925 |
| 71 | NM_002269 | KPNA5 | 6.822 | 5.908 | 6.451 | 5.758 | 5.712 | 0.000000 | 1.000000 | 0.000021 | 0.000000 | 0.945115 |
| 387 | NM_002269 | KPNA5 | 6.822 | 5.908 | 6.451 | 5.758 | 5.712 | 0.000000 | 1.000000 | 0.000021 | 0.000000 | 0.945115 |
| 278 | NM_001130059 | ATF7 | 5.212 | 5.212 | 5.253 | 5.605 | 5.372 | 1.000000 | 0.438013 | 0.000033 | 0.171523 | 0.007397 |
| 580 | NM_001130059 | ATF7 | 5.212 | 5.212 | 5.253 | 5.605 | 5.372 | 1.000000 | 0.438013 | 0.000033 | 0.171523 | 0.007397 |
| 81 | NR_046099 | LOC284757 | 6.913 | 8.028 | 6.894 | 7.534 | 7.376 | 0.000001 | 0.000004 | 0.000039 | 0.000364 | 0.493398 |
|  | NR_046099 | LOC284757 | 6.913 | 8.028 | 6.894 | 7.534 | 7.376 | 0.000001 | 0.000004 | 0.000039 | 0.000364 | 0.493398 |

TABLE 2

Severe versus Mild Area Under Curve (AUC)

| SEQ ID Number | Database ID | Gene Name | HC vs. Sick AUC | HC vs. SIRS AUC | HC vs. ipSIRS AUC | inSIRS vs. ipSIRS AUC | Mild vs. Severe AUC | Mild vs. Shock AUC | Severe vs. Shock AUC |
|---|---|---|---|---|---|---|---|---|---|
| 195 | NM_004897 | MINPP1 | 0.689217443 | 0.699775533 | 0.685388685 | 0.532134532 | 0.88707483 | 0.779591837 | 0.488435374 |
| 504 | NM_004897 | MINPP1 | 0.689217443 | 0.699775533 | 0.685388685 | 0.532134532 | 0.88707483 | 0.779591837 | 0.488435374 |
| 285 | NM_019091 | PLEKHA3 | 0.584378734 | 0.644781145 | 0.562474562 | 0.541791542 | 0.874829932 | 0.794285714 | 0.619047619 |
| 587 | NM_019091 | PLEKHA3 | 0.584378734 | 0.644781145 | 0.562474562 | 0.541791542 | 0.874829932 | 0.794285714 | 0.619047619 |
| 282 | NM_002692 | POLE2 | 0.675029869 | 0.693602694 | 0.668294668 | 0.501165501 | 0.854421769 | 0.707755102 | 0.563265306 |
| 584 | NM_002692 | POLE2 | 0.675029869 | 0.693602694 | 0.668294668 | 0.501165501 | 0.854421769 | 0.707755102 | 0.563265306 |
| 288 | NM_024613 | PLEKHF2 | 0.654868578 | 0.667227834 | 0.65038665 | 0.538794539 | 0.850340136 | 0.692244898 | 0.718367347 |
| 590 | NM_024613 | PLEKHF2 | 0.654868578 | 0.667227834 | 0.65038665 | 0.538794539 | 0.850340136 | 0.692244898 | 0.718367347 |
| 190 | NM_176818 | SFRS9 | 0.597520908 | 0.557800224 | 0.653846154 | 0.748917749 | 0.840816327 | 0.79755102 | 0.587755102 |
| 499 | NM_176818 | SFRS9 | 0.597520908 | 0.557800224 | 0.653846154 | 0.748917749 | 0.840816327 | 0.79755102 | 0.587755102 |
| 170 | NM_003608 | GPR65 | 0.765681004 | 0.735690236 | 0.776556777 | 0.6003996 | 0.839455782 | 0.615510204 | 0.740136054 |
| 480 | NM_003608 | GPR65 | 0.765681004 | 0.735690236 | 0.776556777 | 0.6003996 | 0.839455782 | 0.615510204 | 0.740136054 |
| 232 | gi|14250459 | NA | 0.571983274 | 0.7003367 | 0.525437525 | 0.661338661 | 0.838095238 | 0.83755102 | 0.559183673 |
|  | gi|14250459 | NA | 0.571983274 | 0.7003367 | 0.525437525 | 0.661338661 | 0.838095238 | 0.83755102 | 0.559183673 |
| 197 | NM_006969 | ZNF28 | 0.689964158 | 0.837261504 | 0.636548637 | 0.670662671 | 0.836734694 | 0.796734694 | 0.536054422 |
| 506 | NM_006969 | ZNF28 | 0.689964158 | 0.837261504 | 0.636548637 | 0.670662671 | 0.836734694 | 0.796734694 | 0.536054422 |
| 81 | NR_046099 | LOC284757 | 0.738948626 | 0.939393939 | 0.666259666 | 0.835497835 | 0.834013605 | 0.749387755 | 0.613605442 |
|  | NR_046099 | LOC284757 | 0.738948626 | 0.939393939 | 0.666259666 | 0.835497835 | 0.834013605 | 0.749387755 | 0.613605442 |
| 71 | NM_002269 | KPNA5 | 0.85483871 | 0.895061728 | 0.84025234 | 0.564768565 | 0.831292517 | 0.844897959 | 0.530612245 |
| 387 | NM_002269 | KPNA5 | 0.85483871 | 0.895061728 | 0.84025234 | 0.564768565 | 0.831292517 | 0.844897959 | 0.530612245 |

TABLE 3

Shock vs. Mild p Value

| SEQ ID Number | Database ID | Gene Name | HC Mean | inSIRS Mean | Mild Mean | Severe Mean | Shock Mean | pval.HC. vs. Other | pval. inSIRS. vs.IpSIRS | pval Severe.vs. Mild | pval Shock.vs. Mild | pval Shock.vs. Severe |
|---|---|---|---|---|---|---|---|---|---|---|---|---|
| 59 | NM_014232 | VAMP2 | 9.213 | 8.896 | 9.016 | 8.454 | 8.353 | 0.000000 | 0.297018 | 0.000084 | 0.000000 | 0.708038 |
| 376 | NM_014232 | VAMP2 | 9.213 | 8.896 | 9.016 | 8.454 | 8.353 | 0.000000 | 0.297018 | 0.000084 | 0.000000 | 0.708038 |
| 71 | NM_002269 | KPNA5 | 6.822 | 5.908 | 6.451 | 5.758 | 5.712 | 0.000000 | 1.000000 | 0.000021 | 0.000000 | 0.945115 |
| 387 | NM_002269 | KPNA5 | 6.822 | 5.908 | 6.451 | 5.758 | 5.712 | 0.000000 | 1.000000 | 0.000021 | 0.000000 | 0.945115 |
| 232 | gi|14250459 | NA | 6.389 | 5.970 | 6.875 | 5.976 | 6.059 | 1.000000 | 0.638753 | 0.000001 | 0.000000 | 0.869569 |
|  | gi|14250459 | NA | 6.389 | 5.970 | 6.875 | 5.976 | 6.059 | 1.000000 | 0.638753 | 0.000001 | 0.000000 | 0.869569 |
| 246 | NM_032828 | ZNF587 | 8.514 | 8.816 | 8.783 | 8.381 | 8.101 | 1.000000 | 0.003242 | 0.018153 | 0.000001 | 0.136854 |
| 549 | NM_032828 | ZNF587 | 8.514 | 8.816 | 8.783 | 8.381 | 8.101 | 1.000000 | 0.003242 | 0.018153 | 0.000001 | 0.136854 |
| 195 | NM_004897 | MINPP1 | 8.212 | 7.697 | 8.228 | 7.151 | 7.317 | 0.006705 | 1.000000 | 0.000005 | 0.000008 | 0.707929 |
| 504 | NM_004897 | MINPP1 | 8.212 | 7.697 | 8.228 | 7.151 | 7.317 | 0.006705 | 1.000000 | 0.000005 | 0.000008 | 0.707929 |
| 107 | NM_153236 | GIMAP7 | 9.533 | 8.865 | 8.974 | 8.682 | 8.112 | 0.000000 | 1.000000 | 0.310769 | 0.000008 | 0.014285 |
| 420 | NM_153236 | GIMAP7 | 9.533 | 8.865 | 8.974 | 8.682 | 8.112 | 0.000000 | 1.000000 | 0.310769 | 0.000008 | 0.014285 |
| 285 | NM_019091 | PLEKHA3 | 7.058 | 6.910 | 7.281 | 6.689 | 6.825 | 1.000000 | 1.000000 | 0.000001 | 0.000011 | 0.409707 |
| 587 | NM_019091 | PLEKHA3 | 7.058 | 6.910 | 7.281 | 6.689 | 6.825 | 1.000000 | 1.000000 | 0.000001 | 0.000011 | 0.409707 |
| 58 | NM_002121 | HLA-DPB1 | 11.414 | 10.665 | 10.623 | 9.971 | 9.578 | 0.000000 | 0.067333 | 0.026428 | 0.000013 | 0.253098 |
| 375 | NM_002121 | HLA-DPB1 | 11.414 | 10.665 | 10.623 | 9.971 | 9.578 | 0.000000 | 0.067333 | 0.026428 | 0.000013 | 0.253098 |
| 304 | NR_033759 | ATP5L | 7.242 | 7.337 | 7.379 | 6.824 | 6.772 | 1.000000 | 0.748516 | 0.000612 | 0.000014 | 0.929559 |
|  | NR_033759 | ATP5L | 7.242 | 7.337 | 7.379 | 6.824 | 6.772 | 1.000000 | 0.748516 | 0.000612 | 0.000014 | 0.929559 |
| 197 | NM_006969 | ZNF28 | 4.936 | 4.511 | 5.008 | 4.554 | 4.612 | 0.021118 | 0.027741 | 0.000020 | 0.000018 | 0.814925 |
| 506 | NM_006969 | ZNF28 | 4.936 | 4.511 | 5.008 | 4.554 | 4.612 | 0.021118 | 0.027741 | 0.000020 | 0.000018 | 0.814925 |

TABLE 4

Shock vs. Mild Area Under Curve (AUC)

| SEQ ID Number | Database ID | Gene Name | HC vs. Sick AUC | HC vs. SIRS AUC | HC vs. ipSIRS AUC | inSIRS vs. ipSIRS AUC | Mild vs. Severe AUC | Mild vs. Shock AUC | Severe vs. Shock AUC |
|---|---|---|---|---|---|---|---|---|---|
| 71 | NM_002269 | KPNA5 | 0.85483871 | 0.895061728 | 0.84025234 | 0.564768565 | 0.831292517 | 0.844897959 | 0.530612245 |
| 387 | NM_002269 | KPNA5 | 0.85483871 | 0.895061728 | 0.84025234 | 0.564768565 | 0.831292517 | 0.844897959 | 0.530612245 |
| 246 | NM_032828 | ZNF587 | 0.506571087 | 0.632435466 | 0.539072039 | 0.68964369 | 0.723809524 | 0.84244898 | 0.644897959 |
| 549 | NM_032828 | ZNF587 | 0.506571087 | 0.632435466 | 0.539072039 | 0.68964369 | 0.723809524 | 0.84244898 | 0.644897959 |
| 232 | gi|14250459 | NA | 0.571983274 | 0.7003367 | 0.525437525 | 0.661338661 | 0.838095238 | 0.83755102 | 0.559183673 |
|  | gi|14250459 | NA | 0.571983274 | 0.7003367 | 0.525437525 | 0.661338661 | 0.838095238 | 0.83755102 | 0.559183673 |
| 59 | NM_014232 | VAMP2 | 0.814366786 | 0.78338945 | 0.825600326 | 0.636363636 | 0.810884354 | 0.834285714 | 0.54829932 |
| 376 | NM_014232 | VAMP2 | 0.814366786 | 0.78338945 | 0.825600326 | 0.636363636 | 0.810884354 | 0.834285714 | 0.54829932 |
| 107 | NM_153236 | GIMAP7 | 0.829898447 | 0.80359147 | 0.839438339 | 0.603063603 | 0.617687075 | 0.826938776 | 0.710204082 |
| 420 | NM_153236 | GIMAP7 | 0.829898447 | 0.80359147 | 0.839438339 | 0.603063603 | 0.617687075 | 0.826938776 | 0.710204082 |
| 58 | NM_002121 | HLA-DPB1 | 0.857228196 | 0.814814815 | 0.872608873 | 0.682317682 | 0.693877551 | 0.809795918 | 0.628571429 |
| 375 | NM_002121 | HLA-DPB1 | 0.857228196 | 0.814814815 | 0.872608873 | 0.682317682 | 0.693877551 | 0.809795918 | 0.628571429 |
| 110 | gi|13182974 | NA | 0.796893668 | 0.92704826 | 0.74969475 | 0.743589744 | 0.681632653 | 0.808163265 | 0.617687075 |
| 423 | gi|13182974 | NA | 0.796893668 | 0.92704826 | 0.74969475 | 0.743589744 | 0.681632653 | 0.808163265 | 0.617687075 |
| 64 | NM_004172 | SLC1A3 | 0.954599761 | 0.985409652 | 0.943426943 | 0.636030636 | 0.557823129 | 0.806530612 | 0.823129252 |
| 381 | NM_004172 | SLC1A3 | 0.954599761 | 0.985409652 | 0.943426943 | 0.636030636 | 0.557823129 | 0.806530612 | 0.823129252 |
| 190 | NM_176818 | SFRS9 | 0.597520908 | 0.557800224 | 0.653846154 | 0.748917749 | 0.840816327 | 0.79755102 | 0.587755102 |
| 499 | NM_176818 | SFRS9 | 0.597520908 | 0.557800224 | 0.653846154 | 0.748917749 | 0.840816327 | 0.79755102 | 0.587755102 |
| 197 | NM_006969 | ZNF28 | 0.689964158 | 0.837261504 | 0.636548637 | 0.670662671 | 0.836734694 | 0.796734694 | 0.536054422 |
| 506 | NM_006969 | ZNF28 | 0.689964158 | 0.837261504 | 0.636548637 | 0.670662671 | 0.836734694 | 0.796734694 | 0.536054422 |

TABLE 5

Shock versus Severe p Value

| SEQ ID Number | Database ID | Gene Name | HC Mean | inSIRS Mean | Mild Mean | Severe Mean | Shock Mean | pval. HC.vs. Other | pval. inSIRS.vs. Sepsis | pval Severe.vs. Mild | pval Shock.vs. Mild | pval Shock.vs. Severe |
|---|---|---|---|---|---|---|---|---|---|---|---|---|
| 79 | NM_005546 | ITK | 9.271 | 8.099 | 8.227 | 8.536 | 7.635 | 0.000000 | 1.000000 | 0.276607 | 0.002832 | 0.000063 |
| 395 | NM_005546 | ITK | 9.271 | 8.099 | 8.227 | 8.536 | 7.635 | 0.000000 | 1.000000 | 0.276607 | 0.002832 | 0.000063 |
| 34 | NM_001744 | CAMK4 | 8.155 | 6.723 | 6.902 | 7.152 | 6.470 | 0.000000 | 1.000000 | 0.305982 | 0.011176 | 0.000339 |
| 352 | NM_001744 | CAMK4 | 8.155 | 6.723 | 6.902 | 7.152 | 6.470 | 0.000000 | 1.000000 | 0.305982 | 0.011176 | 0.000339 |
| 64 | NM_004172 | SLC1A3 | 5.849 | 6.892 | 6.472 | 6.447 | 7.373 | 0.000000 | 1.000000 | 0.993673 | 0.000056 | 0.000352 |
| 381 | NM_004172 | SLC1A3 | 5.849 | 6.892 | 6.472 | 6.447 | 7.373 | 0.000000 | 1.000000 | 0.993673 | 0.000056 | 0.000352 |
| 171 | NR_046000 | IRF4 | 8.200 | 7.491 | 7.843 | 8.381 | 7.762 | 0.000105 | 0.000070 | 0.002770 | 0.825556 | 0.000501 |
|  | NR_046000 | IRF4 | 8.200 | 7.491 | 7.843 | 8.381 | 7.762 | 0.000105 | 0.000070 | 0.002770 | 0.825556 | 0.000501 |

TABLE 5-continued

Shock versus Severe p Value

| SEQ ID Number | Database ID | Gene Name | HC Mean | inSIRS Mean | Mild Mean | Severe Mean | Shock Mean | pval. HC.vs. Other | pval. inSIRS.vs. Sepsis | pval Severe.vs. Mild | pval Shock.vs. Mild | pval Shock.vs. Severe |
|---|---|---|---|---|---|---|---|---|---|---|---|---|
| 271 | NM_173485 | TSHZ2 | 7.382 | 6.972 | 6.846 | 7.429 | 6.929 | 0.004682 | 1.000000 | 0.000051 | 0.739871 | 0.000534 |
| 574 | NM_173485 | TSHZ2 | 7.382 | 6.972 | 6.846 | 7.429 | 6.929 | 0.004682 | 1.000000 | 0.000051 | 0.739871 | 0.000534 |
| 22 | NM_005449 | FAIM3 | 10.259 | 9.101 | 9.036 | 9.174 | 8.464 | 0.000000 | 1.000000 | 0.732360 | 0.001453 | 0.000582 |
| 340 | NM_005449 | FAIM3 | 10.259 | 9.101 | 9.036 | 9.174 | 8.464 | 0.000000 | 1.000000 | 0.732360 | 0.001453 | 0.000582 |
| 44 | NM_032047 | B3GNT5 | 6.871 | 8.033 | 8.009 | 7.744 | 8.548 | 0.000000 | 1.000000 | 0.438680 | 0.013149 | 0.000955 |
| 362 | NM_032047 | B3GNT5 | 6.871 | 8.033 | 8.009 | 7.744 | 8.548 | 0.000000 | 1.000000 | 0.438680 | 0.013149 | 0.000955 |
| 229 | NM_207647 | FSD1L | 4.605 | 4.402 | 4.801 | 4.565 | 5.099 | 1.000000 | 0.000000 | 0.235142 | 0.050177 | 0.001077 |
| 534 | NM_207647 | FSD1L | 4.605 | 4.402 | 4.801 | 4.565 | 5.099 | 1.000000 | 0.000000 | 0.235142 | 0.050177 | 0.001077 |
| 198 | gi|21538810 | NPCDR1 | 5.404 | 5.022 | 4.784 | 5.166 | 4.817 | 0.000001 | 1.000000 | 0.000589 | 0.919120 | 0.001847 |
| 507 | gi|21538810 | NPCDR1 | 5.404 | 5.022 | 4.784 | 5.166 | 4.817 | 0.000001 | 1.000000 | 0.000589 | 0.919120 | 0.001847 |
| 220 | NM_207627 | ABCG1 | 8.318 | 7.923 | 7.960 | 8.214 | 7.791 | 0.000000 | 1.000000 | 0.112606 | 0.270961 | 0.003184 |
| 526 | NM_207627 | ABCG1 | 8.318 | 7.923 | 7.960 | 8.214 | 7.791 | 0.000000 | 1.000000 | 0.112606 | 0.270961 | 0.003184 |

TABLE 6

Shock versus Severe Area Under Curve (AUC)

| SEQ ID Number | Database ID | Gene Name | HC vs. Sick AUC | HC vs. SIRS AUC | HC vs. ipSIRS AUC | inSIRS vs. ipSIRS AUC | Mild vs. Severe AUC | Mild vs. Shock AUC | Severe vs. Shock AUC |
|---|---|---|---|---|---|---|---|---|---|
| 64 | NM_004172 | SLC1A3 | 0.954599761 | 0.985409652 | 0.943426943 | 0.636030636 | 0.557823129 | 0.806530612 | 0.823129252 |
| 381 | NM_004172 | SLC1A3 | 0.954599761 | 0.985409652 | 0.943426943 | 0.636030636 | 0.557823129 | 0.806530612 | 0.823129252 |
| 79 | NM_005546 | ITK | 0.888888889 | 0.873737374 | 0.894383394 | 0.520812521 | 0.646258503 | 0.735510204 | 0.805442177 |
| 395 | NM_005546 | ITK | 0.888888889 | 0.873737374 | 0.894383394 | 0.520812521 | 0.646258503 | 0.735510204 | 0.805442177 |
| 22 | NM_005449 | FAIM3 | 0.951612903 | 0.930415264 | 0.959299959 | 0.596070596 | 0.57414966 | 0.749387755 | 0.793197279 |
| 340 | NM_005449 | FAIM3 | 0.951612903 | 0.930415264 | 0.959299959 | 0.596070596 | 0.57414966 | 0.749387755 | 0.793197279 |
| 171 | NR_046000 | IRF4 | 0.776433692 | 0.946127946 | 0.714896215 | 0.741258741 | 0.759183673 | 0.604897959 | 0.782312925 |
|  | NR_046000 | IRF4 | 0.776433692 | 0.946127946 | 0.714896215 | 0.741258741 | 0.759183673 | 0.604897959 | 0.782312925 |
| 34 | NM_001744 | CAMK4 | 0.939217443 | 0.921436588 | 0.945665446 | 0.55977356 | 0.594557823 | 0.725714286 | 0.776870748 |
| 352 | NM_001744 | CAMK4 | 0.939217443 | 0.921436588 | 0.945665446 | 0.55977356 | 0.594557823 | 0.725714286 | 0.776870748 |
| 271 | NM_173485 | TSHZ2 | 0.705197133 | 0.733445567 | 0.694953195 | 0.543456543 | 0.828571429 | 0.528979592 | 0.776870748 |
| 574 | NM_173485 | TSHZ2 | 0.705197133 | 0.733445567 | 0.694953195 | 0.543456543 | 0.828571429 | 0.528979592 | 0.776870748 |
| 88 | NM_181506 | LRRC70 | 0.795997611 | 0.49382716 | 0.901098901 | 0.857808858 | 0.736054422 | 0.515102041 | 0.76462585 |
| 402 | NM_181506 | LRRC70 | 0.795997611 | 0.49382716 | 0.901098901 | 0.857808858 | 0.736054422 | 0.515102041 | 0.76462585 |
| 176 | NM_002230 | JUP | 0.830346476 | 0.75308642 | 0.858363858 | 0.573093573 | 0.500680272 | 0.765714286 | 0.760544218 |
| 485 | NM_002230 | JUP | 0.830346476 | 0.75308642 | 0.858363858 | 0.573093573 | 0.500680272 | 0.765714286 | 0.760544218 |
| 44 | NM_032047 | B3GNT5 | 0.9369773 | 0.948933782 | 0.932641433 | 0.548784549 | 0.565986395 | 0.692244898 | 0.759183673 |
| 362 | NM_032047 | B3GNT5 | 0.9369773 | 0.948933782 | 0.932641433 | 0.548764549 | 0.565986395 | 0.692244898 | 0.759183673 |
| 235 | NM_003531 | HIST1H3C | 0.781212664 | 0.881593715 | 0.744810745 | 0.672327672 | 0.643537415 | 0.651428571 | 0.752380952 |
| 539 | NM_003531 | HIST1H3C | 0.781212664 | 0.881593715 | 0.744810745 | 0.672327672 | 0.643537415 | 0.651428571 | 0.752380952 |

Example 2

Differentiating INSIRS and IPSIRS in Post-Surgical and Medical Patients

Surgical and medical patients often develop inSIRS post-surgery, post-procedural or as part of a co-morbidity or co-morbidities. Such inpatients have a higher incidence of inSIRS and a higher risk of developing ipSIRS. Medical care in such patients therefore involves monitoring for signs of inSIRS and ipSIRS, differentiating between these two conditions, and determining at the earliest possible time when a patient transitions from inSIRS to ipSIRS. The treatment and management of inSIRS and ipSIRS patients is different, since inSIRS patients can be put on mild anti-inflammatory drugs or anti-pyretics and ipSIRS patients must be started on antibiotics as soon as possible for best outcomes. Monitoring post-surgical and medical patients on a regular basis with biomarkers of the present invention will allow nursing and medical practitioners to differentiate inSIRS and ipSIRS at an early stage and hence make informed decisions on choice of therapies and patient management procedures, and ultimately response to therapy. Information provided by these biomarkers will therefore allow medical practitioners to tailor and modify therapies to ensure patients recover quickly from surgery and do not develop ipSIRS. Less time in hospital and less complications leads to considerable savings in medical expenses including through less occupancy time and appropriate use and timing of medications. Practical examples of the use of the biomarkers in Tables 7 and 8 are described.

Table 7 lists the top 10 biomarkers (of 216) in order of ascending p value when comparing the two clinical groups of inSIRS and ipSIRS. A SEQ ID NO. is provided for each IRS biomarker (IRS biomarker polynucleotides range from SEQ ID NO. 1-319, IRS biomarker polypeptides range from SEQ ID No. 320-619), along with a database identification tag (e.g. NM_), a gene name (Gene Name) if there is one, mean expression values for healthy (HC), inSIRS, mild sepsis, severe sepsis and septic shock, and p values for HC vs. all other groups, inSIRS vs. ipSIRS, mild sepsis versus severe sepsis, mild sepsis versus septic shock and septic shock versus severe sepsis. All biomarkers have clinical utility in distinguishing inSIRS and ipSIRS and for distinguishing inSIRS and ipSIRS as early as possible. Seven (7) of these biomarkers are also useful in distinguishing healthy control from sick although this has no clinical utility for post-surgical or medical patients. Some of these biomarkers also have limited utility in determining ipSIRS severity as indicated by respective p values less than 0.05. By example, in Table 7, inSIRS vs. ipSIRS p Value, it can be seen that the gene C11orf82 has a significant p value for both inSIRS versus ipSIRS and Healthy versus other groups and therefore has utility in separating healthy and inSIRS patients from septic patients. From the columns in the table containing mean expression data it can be seen that C11orf82 is down-regulated in both inSIRS (5.888) and healthy controls (5.776) compared to septic patients of all classes (mild (6.889), severe (7.153) and shock (7.293)) (7.281) (also see FIG. 4).

Figure 4:
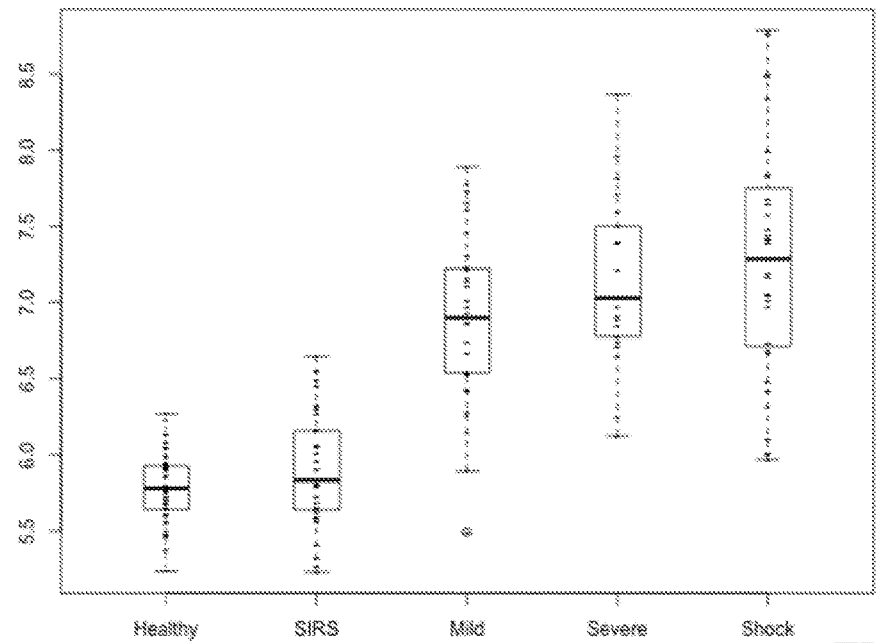
FIG. 4 shows a box and whiskers plot of C11orf82 gene expression for healthy subjects and subjects with SIRS, mild sepsis, severe sepsis.
Figure 5:
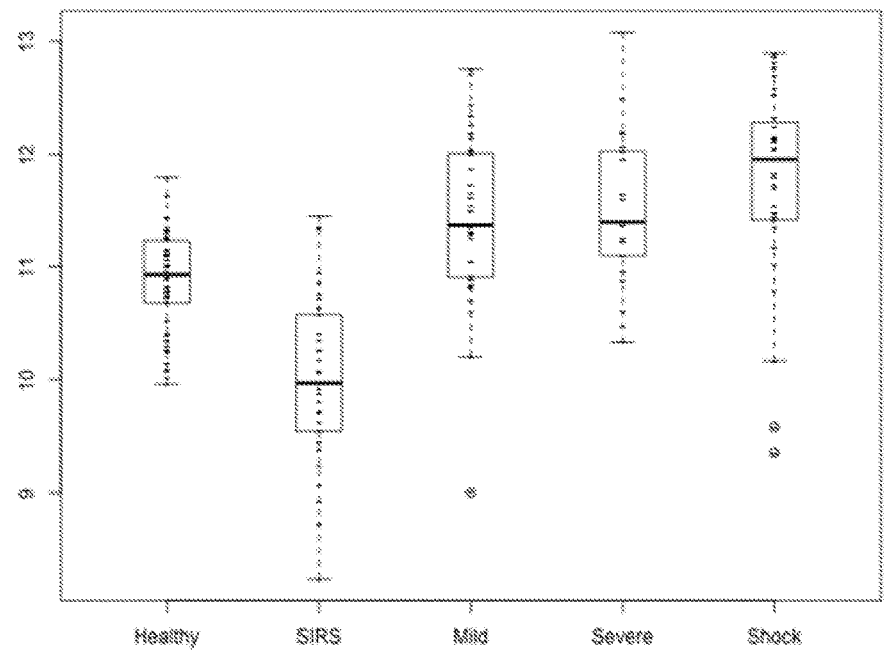
FIG. 5 shows a box and whiskers plot of PLAC8 gene expression for healthy subjects and subjects with SIRS, mild sepsis, severe sepsis.
Figure 6:
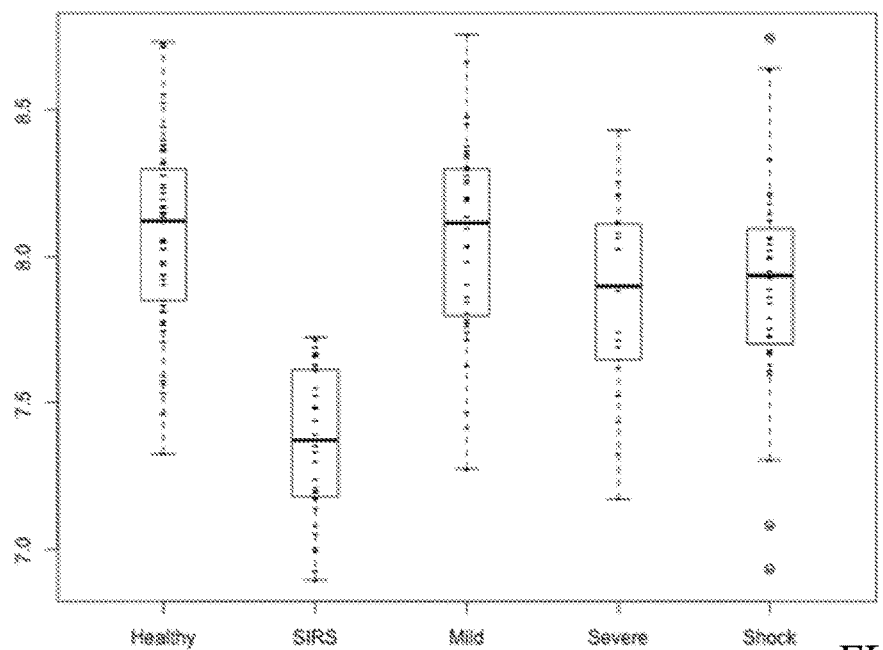
FIG. 6 shows a box and whiskers plot of INSIG1 gene expression for healthy subjects and subjects with SIRS, mild sepsis, severe sepsis.

Table 8 lists the top 10 biomarkers (of 104 with an AUC>0.8) in order of descending AUC when comparing the two clinical groups of inSIRS and ipSIRS and it can be seen that C11orf82, PLAC8 and INSIG1 have AUCs of 0.9477, 0.9210 and 0.9120, respectively (see also FIGS. 4, 5 and 6).

TABLE 7 inSIRS versus ipSIRS p Value

| SEQ ID Number | Database ID | Gene Name | HC Mean | inSIRS Mean | Mild Mean | Severe Mean | Shock Mean | pval HC vs. Other | pval inSIRS vs. ipSIRS | pval Severe vs. Mild | pval Shock vs. Mild | pval Shock vs. Severe |
|---|---|---|---|---|---|---|---|---|---|---|---|---|
| 12 | NM_145018 | C11orf82 | 5.776 | 5.888 | 6.889 | 7.153 | 7.293 | 0.000000 | 0.000000 | 0.322762 | 0.032568 | 0.722429 |
| 330 | NM_145018 | C11orf82 | 5.776 | 5.888 | 6.889 | 7.153 | 7.293 | 0.000000 | 0.000000 | 0.322762 | 0.032568 | 0.722429 |
| 83 | NR_036641 | PDGFC | 6.098 | 6.117 | 6.987 | 7.044 | 7.466 | 0.000000 | 0.000000 | 0.970637 | 0.064634 | 0.196970 |
|  | NR_036641 | PDGFC | 6.098 | 6.117 | 6.987 | 7.044 | 7.466 | 0.000000 | 0.000000 | 0.970637 | 0.064634 | 0.196970 |
| 106 | NM_018375 | SLC39A9 | 8.038 | 7.719 | 8.121 | 8.368 | 8.428 | 1.000000 | 0.000000 | 0.034062 | 0.001276 | 0.808136 |
| 419 | NM_018375 | SLC39A9 | 8.038 | 7.719 | 8.121 | 8.368 | 8.428 | 1.000000 | 0.000000 | 0.034062 | 0.001276 | 0.808136 |
| 150 | NM_030796 | VOPP1 | 9.302 | 8.771 | 9.510 | 9.318 | 9.517 | 1.000000 | 0.000000 | 0.298375 | 0.997162 | 0.269787 |
| 461 | NM_030796 | VOPP1 | 9.302 | 8.771 | 9.510 | 9.318 | 9.517 | 1.000000 | 0.000000 | 0.298375 | 0.997162 | 0.269787 |
| 73 | NM_001257400 | CD63 | 9.235 | 9.126 | 9.718 | 9.990 | 10.159 | 0.000000 | 0.000000 | 0.156468 | 0.002260 | 0.485665 |
| 389 | NM_001257400 | CD63 | 9.235 | 9.126 | 9.718 | 9.990 | 10.159 | 0.000000 | 0.000000 | 0.156468 | 0.002260 | 0.485665 |
| 55 | NM_014143 | CD274 | 5.508 | 5.656 | 7.557 | 7.211 | 7.237 | 0.000000 | 0.000000 | 0.536662 | 0.490374 | 0.996684 |
| 372 | NM_014143 | CD274 | 5.508 | 5.656 | 7.557 | 7.211 | 7.237 | 0.000000 | 0.000000 | 0.536662 | 0.490374 | 0.996684 |
| 111 | NM_198336 | INSIG1 | 8.081 | 7.370 | 8.062 | 7.867 | 7.913 | 0.001237 | 0.000000 | 0.123875 | 0.197540 | 0.883915 |
| 424 | NM_198336 | INSIG1 | 8.081 | 7.370 | 8.062 | 7.867 | 7.913 | 0.001237 | 0.000000 | 0.123875 | 0.197540 | 0.883915 |
| 76 | ENST00000443533 | DDAH2 | 8.067 | 8.170 | 8.630 | 8.707 | 9.015 | 0.000000 | 0.000000 | 0.868573 | 0.011535 | 0.108528 |
| 392 | ENST00000443533 | DDAH2 | 8.067 | 8.170 | 8.630 | 8.707 | 9.015 | 0.000000 | 0.000000 | 0.868573 | 0.011535 | 0.108528 |
| 115 | NM_003546 | HIST1H4L | 9.807 | 7.908 | 9.466 | 9.602 | 9.065 | 0.000032 | 0.000000 | 0.878290 | 0.231084 | 0.140998 |
| 428 | NM_003546 | HIST1H4L | 9.807 | 7.908 | 9.466 | 9.602 | 9.065 | 0.000032 | 0.000000 | 0.878290 | 0.231084 | 0.140998 |
| 226 | NM_003537 | HIST1H3B | 8.783 | 7.684 | 8.739 | 9.501 | 8.852 | 1.000000 | 0.000000 | 0.042709 | 0.908040 | 0.098544 |
| 532 | NM_003537 | HIST1H3B | 8.783 | 7.684 | 8.739 | 9.501 | 8.852 | 1.000000 | 0.000000 | 0.042709 | 0.908040 | 0.098544 |

TABLE 8 inSIRS versus ipSIRS Area Under Curve (AUC)

| SEQ ID Number | Database ID | Gene Name | HC vs. Sick AUC | HC vs. SIRS AUC | HC vs. ipSIRS AUC | inSIRS vs. ipSIRS AUC | Mild vs. Severe AUC | Mild vs. Shock AUC | Severe vs. Shock AUC |
|---|---|---|---|---|---|---|---|---|---|
| 12 | NM_145018 | C11orf82 | 0.873058542 | 0.580246914 | 0.979242979 | 0.947718948 | 0.619047619 | 0.650612245 | 0.555102041 |
| 330 | NM_145018 | C11orf82 | 0.873058542 | 0.580246914 | 0.979242979 | 0.947718948 | 0.619047619 | 0.650612245 | 0.555102041 |
| 72 | NM_001130715 | PLAC8 | 0.635902031 | 0.828282828 | 0.804232804 | 0.921078921 | 0.506122449 | 0.653061224 | 0.642176871 |
| 388 | NM_001130715 | PLAC8 | 0.635902031 | 0.828282828 | 0.804232804 | 0.921078921 | 0.506122449 | 0.653061224 | 0.642176871 |
| 132 | gi|21757933 | NA | 0.533004779 | 0.867564534 | 0.588319088 | 0.912753913 | 0.708843537 | 0.631020408 | 0.540136054 |
| 445 | gi|21757933 | NA | 0.533004779 | 0.867564534 | 0.588319088 | 0.912753913 | 0.708843537 | 0.631020408 | 0.540136054 |
| 111 | NM_198336 | INSIG1 | 0.695191159 | 0.957351291 | 0.6001221 | 0.912087912 | 0.666666667 | 0.631836735 | 0.518367347 |
| 424 | NM_198336 | INSIG1 | 0.695191159 | 0.957351291 | 0.6001221 | 0.912087912 | 0.666666667 | 0.631836735 | 0.518367347 |
| 90 | gi|21749325 | CDS2 | 0.669354839 | 0.730078563 | 0.814204314 | 0.907092907 | 0.586394558 | 0.56244898 | 0.504761905 |
|  | gi|21749325 | CDS2 | 0.669354839 | 0.730078563 | 0.814204314 | 0.907092907 | 0.586394558 | 0.56244898 | 0.504761905 |
| 150 | NM_030796 | VOPP1 | 0.53875448 | 0.937710438 | 0.605921856 | 0.906759907 | 0.63537415 | 0.544489796 | 0.66122449 |
| 461 | NM_030796 | VOPP1 | 0.53875448 | 0.937710438 | 0.605921856 | 0.906759907 | 0.63537415 | 0.544489796 | 0.66122449 |
| 106 | NM_018375 | SLC39A9 | 0.559587814 | 0.775533109 | 0.681115181 | 0.901098901 | 0.730612245 | 0.735510204 | 0.557823129 |
| 419 | NM_018375 | SLC39A9 | 0.559587814 | 0.775533109 | 0.681115181 | 0.901098901 | 0.730612245 | 0.735510204 | 0.557823129 |
| 37 | NM_199135 | FOXD4L3 | 0.815860215 | 0.49382716 | 0.928164428 | 0.900765901 | 0.597278912 | 0.608163265 | 0.48707483 |
| 355 | NM_199135 | FOXD4L3 | 0.815860215 | 0.49382716 | 0.928164428 | 0.900765901 | 0.597278912 | 0.608163265 | 0.48707483 |
| 68 | NM_018639 | WSB2 | 0.782108722 | 0.581369248 | 0.913919414 | 0.9004329 | 0.555102041 | 0.533877551 | 0.530612245 |

TABLE 8-continued inSIRS versus ipSIRS Area Under Curve (AUC)

| SEQ ID Number | Database ID | Gene Name | HC vs. Sick AUC | HC vs. SIRS AUC | HC vs. ipSIRS AUC | inSIRS vs. ipSIRS AUC | Mild vs. Severe AUC | Mild vs. Shock AUC | Severe vs. Shock AUC |
|---|---|---|---|---|---|---|---|---|---|
| 384 | NM_018639 | WSB2 | 0.782108722 | 0.581369248 | 0.913919414 | 0.9004329 | 0.555102041 | 0.533877551 | 0.530612245 |
| 73 | NM_001257400 | CD63 | 0.73655914 | 0.612233446 | 0.863044363 | 0.897768898 | 0.644897959 | 0.72244898 | 0.613605442 |
| 389 | NM_001257400 | CD63 | 0.73655914 | 0.612233446 | 0.863044363 | 0.897768898 | 0.644897959 | 0.72244898 | 0.613605442 |

Example 3

Differentiating Both INSIRS and IPSIRS in Emergency Department Patients and Determining Degree of Illness Patients presenting to emergency departments often have a fever, which is one (of four) of the clinical signs of inSIRS. Such patients need to be assessed to determine if they have either inSIRS or ipSIRS. Further it is important to determine how sick they are to be able to make a judgement call on whether to admit the patient or not. As mentioned above, the treatment and management of pyretic, inSIRS and septic patients are different. By way of example, a patient with a fever without other inSIRS clinical signs and no obvious source of infection may be sent home, or provided with other non-hospital services, without further hospital treatment. However, a patient with a fever may have early ipSIRS and not admitting such a patient may put their life at risk. Because these biomarkers can differentiate inSIRS and ipSIRS and determine how sick a patient is they will allow medical practitioners to triage emergency department patients quickly and effectively. Accurate triage decision-making insures that patients requiring hospital treatment are given it, and those that don't are provided with other appropriate services. Practical examples of the use of the biomarkers in Tables 9 and 10 are described.

Figure 7:
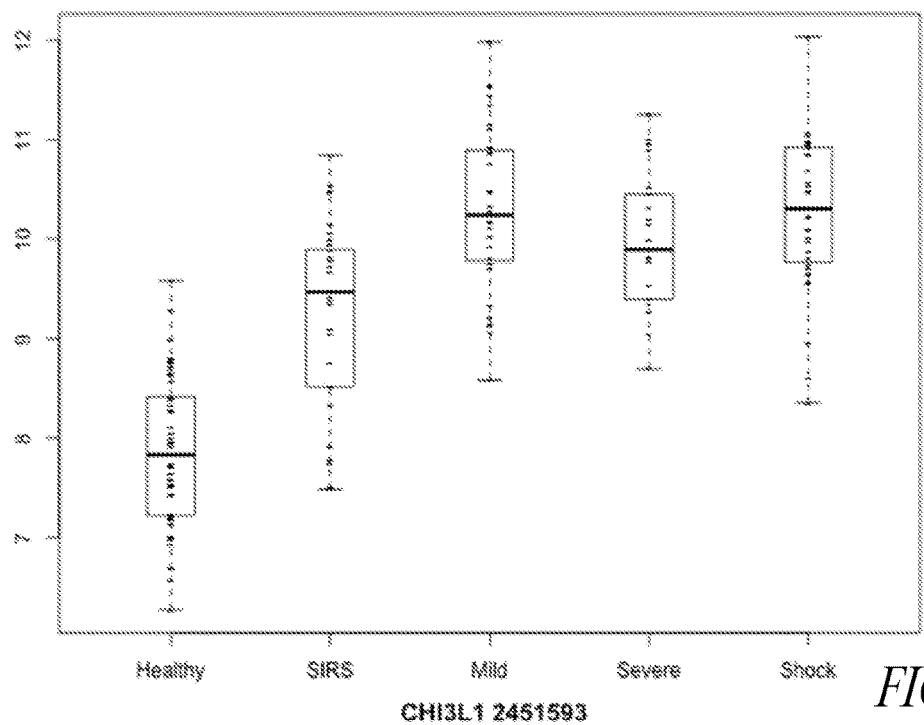
FIG. 7 shows a box and whiskers plot of FCGR1A//FCGR1B//FCGR1C gene expression for healthy subjects and subjects with SIRS, mild sepsis, severe sepsis.

Table 9 lists 30 significant biomarkers when comparing the groups of healthy and sick (sick consisting of those patients with either inSIRS or ipSIRS) and inSIRS versus ipSIRS. A SEQ ID NO. is provided for each IRS biomarker (IRS biomarker polynucleotides range from SEQ ID NO. 1-319, IRS biomarker polypeptides range from SEQ ID No. 320-619), along with a database identification tag (e.g. NM_), a gene name (Gene Name) if there is one, mean expression values for healthy (HC), inSIRS, mild sepsis, severe sepsis and septic shock, and p values for HC vs. all other groups, inSIRS vs. ipSIRS, mild sepsis versus severe sepsis, mild sepsis versus septic shock and septic shock versus severe sepsis. Such biomarkers have clinical utility in distinguishing healthy from sick patients and inSIRS from ipSIRS patients. By example, in Table 9, Healthy versus inSIRS versus ipSIRS, it can be seen that the gene FCGR1A has a significant p value for both inSIRS versus ipSIRS and Healthy versus other groups and therefore has utility in separating healthy and inSIRS and ipSIRS patients. From the columns in the table containing mean expression data it can be seen that FCGR1A is up-regulated in inSIRS (9.281) compared to healthy controls (7.871) but more so in ipSIRS patients (9.985-10.308). Such a upward gradient in gene expression can be used to determine the degree of illness in patients presenting to an emergency department allowing clinicians to risk stratify and triage with greater certainty (see also FIG. 7).

Figure 8:
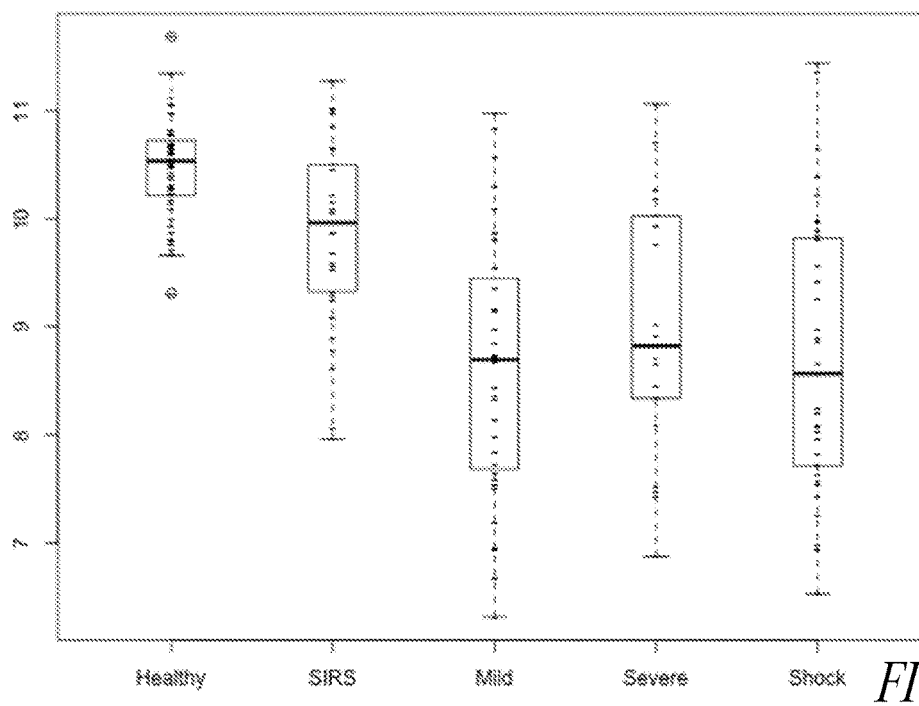
FIG. 8 shows a box and whiskers plot of CHI3L1 gene expression for healthy subjects and subjects with SIRS, mild sepsis, severe sepsis.

Table 10 lists 10 significant biomarkers when comparing the groups of healthy and sick (sick consisting of those patients with either inSIRS or ipSIRS) and inSIRS versus ipSIRS. A SEQ ID NO. is provided for each IRS biomarker (IRS biomarker polynucleotides range from SEQ ID NO. 1-319, IRS biomarker polypeptides range from SEQ ID No. 320-619), along with a database identification tag (e.g. NM_), a gene name (Gene Name) if there is one, mean expression values for healthy (HC), inSIRS, mild sepsis, severe sepsis and septic shock, and p values for HC vs. all other groups, inSIRS vs. ipSIRS, mild sepsis versus severe sepsis, mild sepsis versus septic shock and septic shock versus severe sepsis. Such biomarkers have clinical utility in distinguishing healthy from sick patients and inSIRS from ipSIRS patients. By example, in Table 10, Healthy versus inSIRS versus ipSIRS, it can be seen that the gene CHI3L1 has a significant p value for both inSIRS versus ipSIRS and Healthy versus other groups and therefore has utility in separating healthy and inSIRS and septic patients. From the columns in the table containing mean expression data it can be seen that CHI3L1 is down-regulated in inSIRS (9.876) compared to healthy controls (10.47) but more so in ipSIRS patients (8.64-9.035). Such a downward gradient in gene expression can be used to determine the degree of illness in patients presenting to an emergency department allowing clinicians to risk stratify and triage with greater certainty (see also FIG. 8).

TABLE 9

Healthy versus inSIRS versus ipSIRS p Value

| SEQ ID Number | Database ID | Gene Name | HC Mean | inSIRS Mean | Mild Mean | Severe Mean | Shock Mean | pval HC vs. Other | pval inSIRS vs. ipSIRS | pval Severe vs. Mild | pval Shock vs. Mild | pval Shock vs. Severe |
|---|---|---|---|---|---|---|---|---|---|---|---|---|
| 11 | NR_045213 | FCGR1A | 7.871 | 9.281 | 10.308 | 9.985 | 10.273 | 0.000000 | 0.001046 | 0.284201 | 0.980298 | 0.366022 |
| Non-coding | NR_045213 | FCGR1A | 7.871 | 9.281 | 10.308 | 9.985 | 10.273 | 0.000000 | 0.001046 | 0.284201 | 0.980298 | 0.366022 |
| 20 | NM_153046 | TDRD9 | 4.986 | 5.567 | 6.483 | 6.937 | 7.385 | 0.000000 | 0.000000 | 0.248195 | 0.001153 | 0.259068 |
| 338 | NM_153046 | TDRD9 | 4.986 | 5.567 | 6.483 | 6.937 | 7.385 | 0.000000 | 0.000000 | 0.248195 | 0.001153 | 0.259068 |
| 29 | NM_020370 | GPR84 | 6.712 | 8.157 | 9.030 | 8.980 | 9.583 | 0.000000 | 0.001894 | 0.989573 | 0.184680 | 0.221197 |
| 347 | NM_020370 | GPR84 | 6.712 | 8.157 | 9.030 | 8.980 | 9.583 | 0.000000 | 0.001894 | 0.989573 | 0.184680 | 0.221197 |
| 25 | NM_018367 | ACER3 | 7.317 | 7.845 | 8.701 | 8.417 | 9.050 | 0.000000 | 0.000000 | 0.362961 | 0.132905 | 0.008450 |
| 343 | NM_018367 | ACER3 | 7.317 | 7.845 | 8.701 | 8.417 | 9.050 | 0.000000 | 0.000000 | 0.362961 | 0.132905 | 0.008450 |

TABLE 9-continued

Healthy versus inSIRS versus ipSIRS p Value

| SEQ ID Number | Database ID | Gene Name | HC Mean | inSIRS Mean | Mild Mean | Severe Mean | Shock Mean | pval HC vs. Other | pval inSIRS vs. ipSIRS | pval Severe vs. Mild | pval Shock vs. Mild | pval Shock vs. Severe |
|---|---|---|---|---|---|---|---|---|---|---|---|---|
| 86 | NM_000860 | HPGD | 5.621 | 6.238 | 7.085 | 6.908 | 7.946 | 0.000000 | 0.000025 | 0.895298 | 0.035905 | 0.027021 |
| 400 | NM_000860 | HPGD | 5.621 | 6.238 | 7.085 | 6.908 | 7.946 | 0.000000 | 0.000025 | 0.895298 | 0.035905 | 0.027021 |
| 65 | NM_006418 | OLFM4 | 6.365 | 7.209 | 8.023 | 9.641 | 9.322 | 0.000000 | 0.000069 | 0.003150 | 0.006691 | 0.784808 |
| 382 | NM_006418 | OLFM4 | 6.365 | 7.209 | 8.023 | 9.641 | 9.322 | 0.000000 | 0.000069 | 0.003150 | 0.006691 | 0.784808 |
| 8 | NM_004054 | C3AR1 | 8.429 | 9.449 | 10.261 | 10.439 | 10.593 | 0.000000 | 0.000016 | 0.650271 | 0.142678 | 0.725241 |
| 327 | NM_004054 | C3AR1 | 8.429 | 9.449 | 10.261 | 10.439 | 10.593 | 0.000000 | 0.000016 | 0.650271 | 0.142678 | 0.725241 |
| 6 | NM_002934 | RNASE2 | 9.164 | 10.500 | 11.243 | 11.670 | 11.388 | 0.000000 | 0.002979 | 0.095954 | 0.690976 | 0.351809 |
| 325 | NM_002934 | RNASE2 | 9.164 | 10.500 | 11.243 | 11.670 | 11.388 | 0.000000 | 0.002979 | 0.095954 | 0.690976 | 0.351809 |
| 21 | NM_032045 | KREMEN1 | 8.626 | 9.409 | 10.143 | 10.189 | 10.055 | 0.000000 | 0.000079 | 0.962640 | 0.837239 | 0.731337 |
| 339 | NM_032045 | KREMEN1 | 8.626 | 9.409 | 10.143 | 10.189 | 10.055 | 0.000000 | 0.000079 | 0.962640 | 0.837239 | 0.731337 |
| 1 | NM_003268 | TLR5 | 7.747 | 9.010 | 9.726 | 9.979 | 10.311 | 0.000000 | 0.000225 | 0.275728 | 0.000244 | 0.110996 |
| 320 | NM_003268 | TLR5 | 7.747 | 9.010 | 9.726 | 9.979 | 10.311 | 0.000000 | 0.000225 | 0.275728 | 0.000244 | 0.110996 |
| 280 | NM_153021 | PLB1 | 8.205 | 8.887 | 9.574 | 9.463 | 10.019 | 0.000000 | 0.000133 | 0.872838 | 0.059398 | 0.037699 |
| 582 | NM_153021 | PLB1 | 8.205 | 8.887 | 9.574 | 9.463 | 10.019 | 0.000000 | 0.000133 | 0.872838 | 0.059398 | 0.037699 |
| 15 | NM_004482 | GALNT3 | 5.685 | 6.251 | 6.916 | 6.728 | 7.075 | 0.000000 | 0.000000 | 0.407446 | 0.422801 | 0.051201 |
| 333 | NM_004482 | GALNT3 | 5.685 | 6.251 | 6.916 | 6.728 | 7.075 | 0.000000 | 0.000000 | 0.407446 | 0.422801 | 0.051201 |
| 161 | NM_001816 | CEACAM8 | 7.336 | 7.874 | 8.503 | 9.775 | 9.287 | 0.000000 | 0.001298 | 0.011921 | 0.098854 | 0.501991 |
| 472 | NM_001816 | CEACAM8 | 7.336 | 7.874 | 8.503 | 9.775 | 9.287 | 0.000000 | 0.001298 | 0.011921 | 0.098854 | 0.501991 |
| 36 | NM_007115 | TNFAIP6 | 7.738 | 9.246 | 9.829 | 9.631 | 9.738 | 0.000000 | 1.000000 | 0.712067 | 0.908467 | 0.905260 |
| 354 | NM_007115 | TNFAIP6 | 7.738 | 9.246 | 9.829 | 9.631 | 9.738 | 0.000000 | 1.000000 | 0.712067 | 0.908467 | 0.905260 |
| 4 | NM_016021 | UBE2J1 | 8.792 | 9.555 | 10.118 | 10.044 | 10.335 | 0.000000 | 0.000015 | 0.817659 | 0.104460 | 0.049488 |
| 323 | NM_016021 | UBE2J1 | 8.792 | 9.555 | 10.118 | 10.044 | 10.335 | 0.000000 | 0.000015 | 0.817659 | 0.104460 | 0.049488 |
| 35 | NM_015268 | DNAJC13 | 7.507 | 8.083 | 8.596 | 8.693 | 8.878 | 0.000000 | 0.000000 | 0.833718 | 0.133216 | 0.512817 |
| 353 | NM_015268 | DNAJC13 | 7.507 | 8.083 | 8.596 | 8.693 | 8.878 | 0.000000 | 0.000000 | 0.833718 | 0.133216 | 0.512817 |

TABLE 10

Healthy versus inSIRS versus ipSIRS p Value

| SEQ ID Number | Database ID | Gene Name | HC Mean | inSIRS Mean | Mild Mean | Severe Mean | Shock Mean | pval HC vs. Other | pval inSIRS vs. ipSIRS | pval Severe vs. Mild | pval Shock vs. Mild | pval Shock vs. Severe |
|---|---|---|---|---|---|---|---|---|---|---|---|---|
| 104 | NM_001276 | CHI3L1 | 10.470 | 9.876 | 8.640 | 9.035 | 8.726 | 0.000000 | 0.000056 | 0.485576 | 0.954853 | 0.641602 |
| 417 | NM_001276 | CHI3L1 | 10.470 | 9.876 | 8.640 | 9.035 | 8.726 | 0.000000 | 0.000056 | 0.485576 | 0.954853 | 0.641602 |
| 122 | NM_001143804 | PHOSPHO1 | 11.398 | 10.826 | 10.374 | 9.837 | 10.185 | 0.000000 | 0.048380 | 0.088690 | 0.661703 | 0.354179 |
| 435 | NM_001143804 | PHOSPHO1 | 11.398 | 10.826 | 10.374 | 9.837 | 10.185 | 0.000000 | 0.048380 | 0.088690 | 0.661703 | 0.354179 |
| 40 | NM_016523 | KLRF1 | 6.343 | 5.438 | 5.022 | 4.504 | 4.543 | 0.000000 | 0.007278 | 0.033428 | 0.021421 | 0.979558 |
| 358 | NM_016523 | KLRF1 | 6.343 | 5.438 | 5.022 | 4.504 | 4.543 | 0.000000 | 0.007278 | 0.033428 | 0.021421 | 0.979558 |
| 33 | NM_000953 | PTGDR | 9.310 | 8.373 | 8.028 | 7.790 | 7.577 | 0.000000 | 0.007043 | 0.500548 | 0.040553 | 0.570947 |
| 351 | NM_000953 | PTGDR | 9.310 | 8.373 | 8.028 | 7.790 | 7.577 | 0.000000 | 0.007043 | 0.500548 | 0.040553 | 0.570947 |
| 103 | ENST00000381907 | KLRD1 | 8.651 | 8.097 | 7.766 | 7.201 | 7.123 | 0.000000 | 0.011838 | 0.056985 | 0.008125 | 0.944270 |
| 416 | ENST00000381907 | KLRD1 | 8.651 | 8.097 | 7.766 | 7.201 | 7.123 | 0.000000 | 0.011838 | 0.056985 | 0.008125 | 0.944270 |

Example 4

Differentiating Healthy from Sick Patients and Determining Degree of Illness

Patients presenting to medical clinics often have any one of the four clinical signs of inSIRS (increased heart rate, increased respiratory rate, abnormal white blood cell count, fever or hypothermia). Many different clinical conditions can present with one of the four clinical signs of inSIRS and such patients need to be assessed to determine if they have either inSIRS or ipSIRS and to exclude other differential diagnoses. By way of example, a patient with colic might also present with clinical signs of increased heart rate. Differential diagnoses could be (but not limited to) appendicitis, urolithiasis, cholecystitis, pancreatitis, enterocolitis. In each of these conditions it would be important to determine if there was a systemic inflammatory response (inSIRS) or whether an infection was contributing to the condition. The treatment and management of patients with and without systemic inflammation and/or infection are different. Because these biomarkers can differentiate healthy from sick (inSIRS and ipSIRS), and determine the degree of systemic involvement, the use of them will allow medical practitioners to determine the next medical procedure(s) to perform to satisfactorily resolve the patient issue. Practical examples of the use of the biomarkers in Tables 11, 12, 13 and 14 are described.

Figure 9:
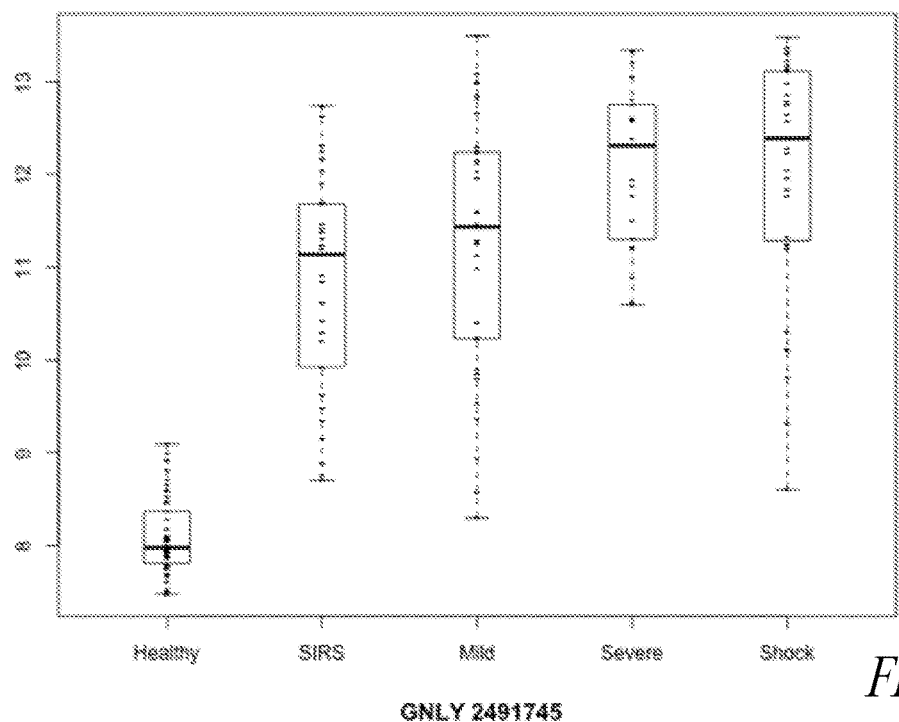
FIG. 9 shows a box and whiskers plot of CD177 gene expression for healthy subjects and subjects with SIRS, mild sepsis, severe sepsis.

Table 11 lists 20 significant biomarkers (of 150) when comparing the groups of healthy and sick (sick consisting of those patients with either inSIRS or ipSIRS). A SEQ ID NO. is provided for each IRS biomarker (IRS biomarker polynucleotides range from SEQ ID NO. 1-319, IRS biomarker polypeptides range from SEQ ID No. 320-619), along with a database identification tag (e.g. NM_), a gene name (Gene Name) if there is one, mean expression values for healthy (HC), inSIRS, mild sepsis, severe sepsis and septic shock, and p values for HC vs. all other groups, inSIRS vs. ipSIRS, mild sepsis versus severe sepsis, mild sepsis versus septic shock and septic shock versus severe sepsis. Such biomarkers have clinical utility in distinguishing healthy from sick patients and determining the level of systemic inflammation and/or infection. For example, in Table 11, Healthy versus Sick, it can be seen that the gene CD177 has a significant p value for healthy control versus other groups and therefore has utility in separating healthy and sick patients. From the columns in the table containing mean expression data it can be seen that CD177 is up-regulated in inSIRS (10.809) compared to healthy controls (8.091) but more so in ipSIRS patients (11.267-12.088). Such up-regulated differences in gene expression can be used to determine the degree of systemic inflammation and infection in patients presenting to clinics allowing clinicians to more easily determine the next medical procedure(s) to perform to satisfactorily resolve the patient issue (see also FIG. 9).

Figure 10:
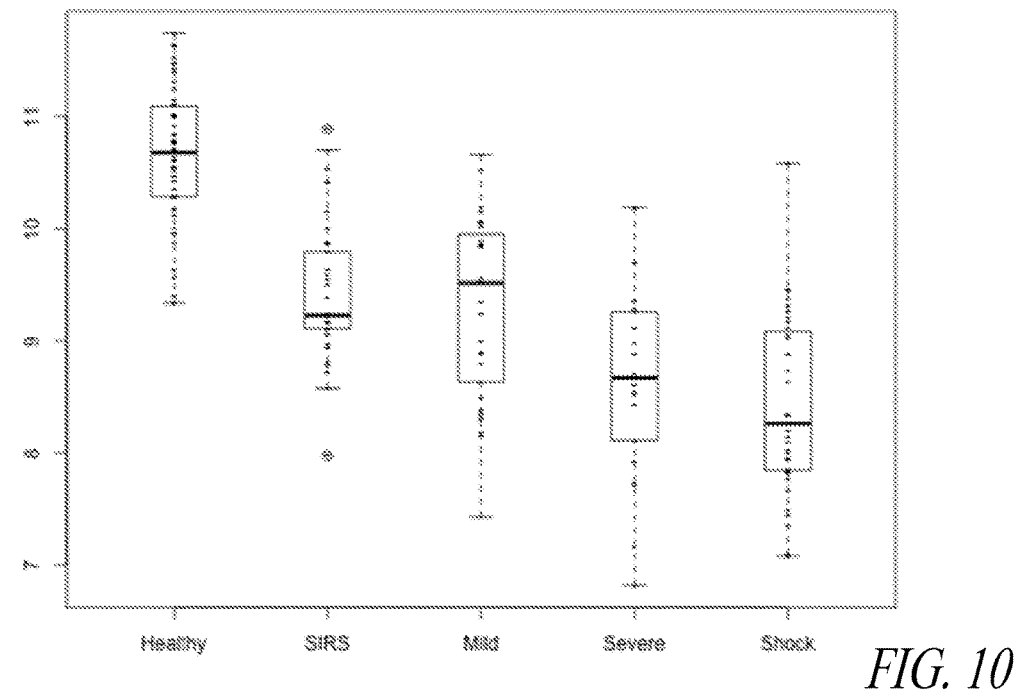
FIG. 10 shows a box and whiskers plot of GNLY gene expression for healthy subjects and subjects with SIRS, mild sepsis, severe sepsis.

Further, and by example, in Table 11, Healthy versus Sick, it can be seen that the gene GNLY has a significant p value for healthy control versus other groups and therefore has utility in separating healthy and sick patients. From the columns in the table containing mean expression data it can be seen that GNLY is down-regulated in inSIRS (9.428) compared to healthy controls (10.653) but more so in septic patients (9.305-8.408). GNLY has an AUC of 0.9445 (not shown) for separating healthy and sick patients. Such down-regulated differences in gene expression can be used to determine the degree of systemic inflammation and infection in patients presenting to clinics allowing clinicians to more easily determine the next medical procedure(s) to perform to satisfactorily resolve the patient issue (see also FIG. 10).

Table 12 lists the top 10 biomarkers (of 118 with an AUC of at least 0.8) for separating healthy from sick patients (sick being those patients with either inSIRS or ipSIRS) by decreasing value of Area Under Curve (AUC). It can be seen that the highest AUC is for CD177 for separating healthy from sick (0.9929) (see also FIG. 9).

Figure 11:
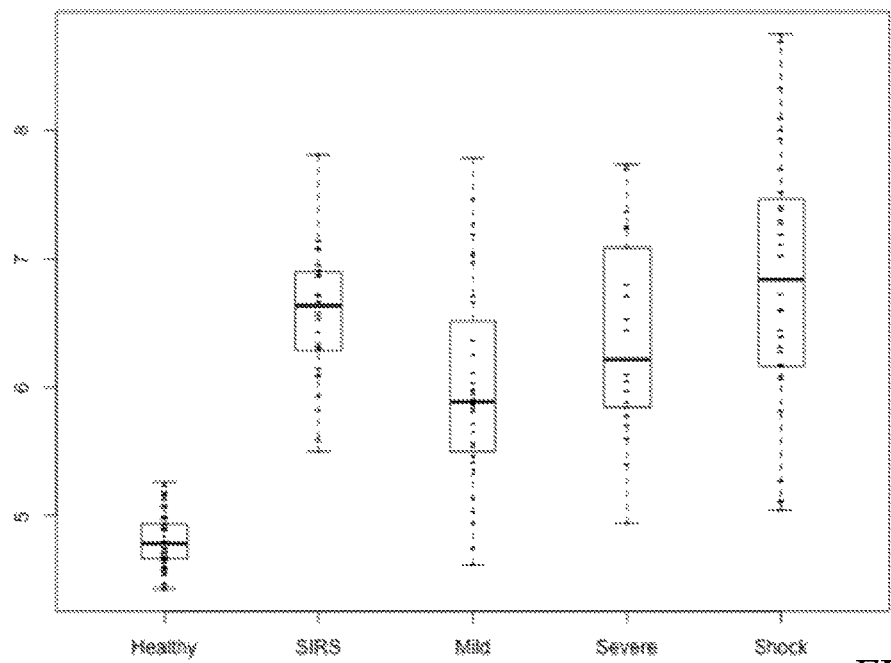
FIG. 11 shows a box and whiskers plot of BMX//HNRPDL gene expression for healthy subjects and subjects with SIRS, mild sepsis, severe sepsis.

Table 13 lists the top 10 biomarkers (of 152 with an AUC of at least 0.8) for separating healthy from inSIRS patients by decreasing value of Area Under Curve (AUC). It can be seen that the highest AUC is for BMX for separating healthy from inSIRS (1). That is, this biomarker alone can perfectly separate these two groups (see also FIG. 11).

Figure 12:
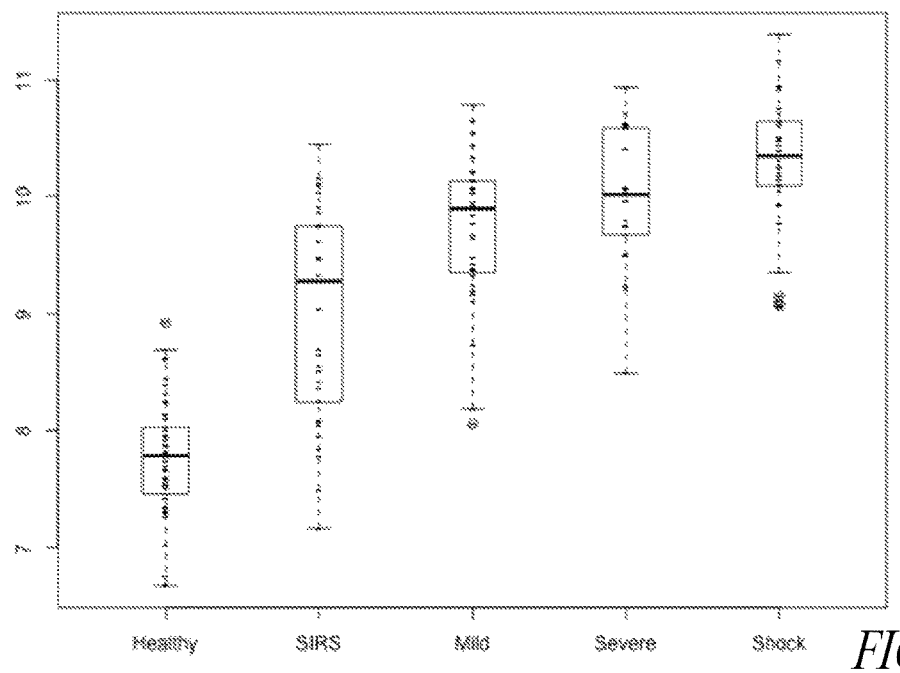
FIG. 12 shows a box and whiskers plot of TLR5 gene expression for healthy subjects and subjects with SIRS, mild sepsis, severe sepsis.

Table 14 lists the top 10 biomarkers (of 140 with an AUC of at least 0.8) for separating healthy from ipSIRS patients by decreasing value of Area Under Curve (AUC). It can be seen that the highest AUC is for TLR5 for separating healthy from ipSIRS (0.9945) (see also FIG. 12).

TABLE 11

Healthy versus Sick p Value

| SEQ ID Number | Database ID | Gene Name | HC Mean | SIRS Mean | Mild Mean | Severe Mean | Shock Mean | pval HC vs. Other | pval SIRS vs. ipSIRS | pval Severe vs. Mild | pval Shock vs. Mild | pval Shock vs. Severe |
|---|---|---|---|---|---|---|---|---|---|---|---|---|
| 2 | NM_020406 | CD177 | 8.091 | 10.809 | 11.267 | 12.088 | 12.044 | 0.000000 | 0.087061 | 0.048910 | 0.027926 | 0.991139 |
| 321 | NM_020406 | CD177 | 8.091 | 10.809 | 11.267 | 12.088 | 12.044 | 0.000000 | 0.087061 | 0.048910 | 0.027926 | 0.991139 |
| 10 | NM_001244438 | ARG1 | 5.410 | 9.054 | 7.895 | 8.254 | 8.919 | 0.000000 | 1.000000 | 0.628534 | 0.008931 | 0.209877 |
| 329 | NM_001244438 | ARG1 | 5.410 | 9.054 | 7.895 | 8.254 | 8.919 | 0.000000 | 1.000000 | 0.628534 | 0.008931 | 0.209877 |
| 3 | NM_004666 | VNN1 | 7.736 | 10.013 | 10.007 | 10.629 | 10.876 | 0.000000 | 1.000000 | 0.087388 | 0.002402 | 0.671136 |
| 322 | NM_004666 | VNN1 | 7.736 | 10.013 | 10.007 | 10.629 | 10.876 | 0.000000 | 1.000000 | 0.087388 | 0.002402 | 0.671136 |
| 7 | NM_080387 | CLEC4D | 7.187 | 9.915 | 9.238 | 9.152 | 9.828 | 0.000000 | 0.383427 | 0.945300 | 0.034026 | 0.035853 |
| 326 | NM_080387 | CLEC4D | 7.187 | 9.915 | 9.238 | 9.152 | 9.828 | 0.000000 | 0.383427 | 0.945300 | 0.034026 | 0.035853 |
| 29 | NM_020370 | GPR84 | 6.712 | 8.157 | 9.030 | 8.980 | 9.583 | 0.000000 | 0.001894 | 0.989573 | 0.184680 | 0.221197 |
| 347 | NM_020370 | GPR84 | 6.712 | 8.157 | 9.030 | 8.980 | 9.583 | 0.000000 | 0.001894 | 0.989573 | 0.184680 | 0.221197 |
| 24 | NM_003855 | IL18R1 | 5.516 | 8.101 | 7.098 | 7.538 | 8.097 | 0.000000 | 1.000000 | 0.373616 | 0.001873 | 0.205385 |
| 342 | NM_003855 | IL18R1 | 5.516 | 8.101 | 7.098 | 7.538 | 8.097 | 0.000000 | 1.000000 | 0.373616 | 0.001873 | 0.205385 |
| 65 | NM_006418 | OLFM4 | 6.365 | 7.209 | 8.023 | 9.641 | 9.322 | 0.000000 | 0.000068 | 0.003150 | 0.006691 | 0.784808 |
| 382 | NM_006418 | OLFM4 | 6.365 | 7.209 | 8.023 | 9.641 | 9.322 | 0.000000 | 0.000068 | 0.003150 | 0.006691 | 0.784808 |
| 11 | NR_045213 | FCGR1A | 7.871 | 9.281 | 10.308 | 9.985 | 10.273 | 0.000000 | 0.001046 | 0.284201 | 0.980298 | 0.366022 |
|  | NR_045213 | FCGR1A | 7.871 | 9.281 | 10.308 | 9.985 | 10.273 | 0.000000 | 0.001046 | 0.284201 | 0.980298 | 0.366022 |
| 6 | NM_002934 | RNASE2 | 9.164 | 10.500 | 11.243 | 11.670 | 11.388 | 0.000000 | 0.002979 | 0.095954 | 0.690976 | 0.351809 |
| 325 | NM_002934 | RNASE2 | 9.164 | 10.500 | 11.243 | 11.670 | 11.388 | 0.000000 | 0.002979 | 0.095954 | 0.690976 | 0.351809 |
| 14 | NM_006433 | GNLY | 10.653 | 9.428 | 9.305 | 8.659 | 8.408 | 0.000000 | 0.020098 | 0.014566 | 0.000045 | 0.511511 |
| 332 | NM_006433 | GNLY | 10.653 | 9.428 | 9.305 | 8.659 | 8.408 | 0.000000 | 0.020098 | 0.014566 | 0.000045 | 0.511511 |

TABLE 12

Healthy versus Sick Area Under Curve (AUC)

| SEQ ID Number | Database ID | Gene Name | HC vs. Sick AUC | HC vs. inSIRS AUC | HC vs. ipSIRS AUC | SIRS vs. ipSIRS AUC | Mild vs. Severe AUC | Mild vs. Shock AUC | Severe vs. Shock AUC |
|---|---|---|---|---|---|---|---|---|---|
| 2 | NM_020406 | CD177 | 0.992980884 | 0.991582492 | 0.993487993 | 0.718281718 | 0.668027211 | 0.675102041 | 0.540136054 |
| 321 | NM_020406 | CD177 | 0.992980884 | 0.991582492 | 0.993487993 | 0.718281718 | 0.668027211 | 0.675102041 | 0.540136054 |
| 7 | NM_080387 | CLEC4D | 0.981780167 | 0.998877666 | 0.975579976 | 0.64968365 | 0.52244898 | 0.671020408 | 0.691156463 |
| 326 | NM_080387 | CLEC4D | 0.98170167 | 0.998877666 | 0.975579976 | 0.64968365 | 0.52244898 | 0.671020408 | 0.691156463 |
| 18 | NM_203281 | BMX | 0.979988053 | 1 | 0.972730973 | 0.56043956 | 0.639455782 | 0.749387755 | 0.644897959 |
| 336 | NM_203281 | BMX | 0.979988053 | 1 | 0.972730973 | 0.56043956 | 0.639455782 | 0.749387755 | 0.644897959 |
| 3 | NM_004666 | VNN1 | 0.979241338 | 0.996632997 | 0.972934473 | 0.663003663 | 0.648979592 | 0.710204082 | 0.575510204 |
| 322 | NM_004666 | VNN1 | 0.979241338 | 0.996632997 | 0.972934473 | 0.663003663 | 0.648979592 | 0.710204082 | 0.575510204 |

TABLE 12-continued

Healthy versus Sick Area Under Curve (AUC)

| SEQ ID Number | Database ID | Gene Name | HC vs. Sick AUC | HC vs. inSIRS AUC | HC vs. ipSIRS AUC | SIRS vs. ipSIRS AUC | Mild vs. Severe AUC | Mild vs. Shock AUC | Severe vs. Shock AUC |
|---|---|---|---|---|---|---|---|---|---|
| 29 | NM_020370 | GPR84 | 0.974313023 | 0.92704826 | 0.991452991 | 0.738927739 | 0.496598639 | 0.608163265 | 0.623129252 |
| 347 | NM_020370 | GPR84 | 0.974313023 | 0.92704826 | 0.991452991 | 0.738927739 | 0.496598639 | 0.608163265 | 0.623129252 |
| 10 | NM_001244438 | ARG1 | 0.970878136 | 0.999438833 | 0.960520961 | 0.644355644 | 0.561904762 | 0.683265306 | 0.662585034 |
| 329 | NM_001244438 | ARG1 | 0.970878136 | 0.999438833 | 0.960520961 | 0.644355644 | 0.561904762 | 0.683265306 | 0.662585034 |
| 24 | NM_003855 | IL18R1 | 0.966845878 | 0.989337823 | 0.958689459 | 0.62970363 | 0.62585034 | 0.715102041 | 0.639455782 |
| 342 | NM_003855 | IL18R1 | 0.966845878 | 0.989337823 | 0.958689459 | 0.62970363 | 0.62585034 | 0.715102041 | 0.639455782 |
| 26 | NM_006459 | ERLIN1 | 0.964755078 | 0.994949495 | 0.953805454 | 0.694971695 | 0.561904762 | 0.639183673 | 0.594557823 |
| 344 | NM_006459 | ERLIN1 | 0.964755078 | 0.994949495 | 0.953805454 | 0.694971695 | 0.561904762 | 0.639183673 | 0.594557823 |
| 5 | NM_018285 | IMP3 | 0.96385902 | 0.997755331 | 0.951566952 | 0.817515818 | 0.610884354 | 0.742040816 | 0.614965986 |
| 324 | NM_018285 | IMP3 | 0.96385902 | 0.997755331 | 0.951566952 | 0.817515818 | 0.610884354 | 0.742040816 | 0.614965986 |
| 1 | NM_003268 | TLR5 | 0.962365591 | 0.873737374 | 0.994505495 | 0.808524809 | 0.606802721 | 0.768979592 | 0.672108844 |
| 320 | NM_003268 | TLR5 | 0.962365591 | 0.873737374 | 0.994505495 | 0.808524809 | 0.606802721 | 0.768979592 | 0.672108844 |

TABLE 13

Healthy versus inSIRS Area Under Curve (AUC)

| SEQ ID Number | Database ID | Gene Name | HC vs. Sick AUC | HC vs. inSIRS AUC | HC vs. ipSIRS AUC | SIRS vs. ipSIRS AUC | Mild vs. Severe AUC | Mild vs. Shock AUC | Severe vs. Shock AUC |
|---|---|---|---|---|---|---|---|---|---|
| 18 | NM_203281 | BMX | 0.979988053 | 1 | 0.972730973 | 0.56043956 | 0.639455782 | 0.749387755 | 0.644897959 |
| 336 | NM_203281 | BMX | 0.979988053 | 1 | 0.972730973 | 0.56043956 | 0.639455782 | 0.749387755 | 0.644897959 |
| 10 | NM_001244438 | ARG1 | 0.970878136 | 0.999438833 | 0.960520961 | 0.644355644 | 0.561904762 | 0.683265306 | 0.662585034 |
| 329 | NM_001244438 | ARG1 | 0.970878136 | 0.999438833 | 0.960520961 | 0.644355644 | 0.561904762 | 0.683265306 | 0.662585034 |
| 7 | NM_080387 | CLEC4D | 0.981780167 | 0.998877666 | 0.975579976 | 0.64968365 | 0.52244898 | 0.671020408 | 0.691156463 |
| 326 | NM_080387 | CLEC4D | 0.981780167 | 0.998877666 | 0.975579976 | 0.64968365 | 0.52244898 | 0.671020408 | 0.691156463 |
| 5 | NM_018285 | IMP3 | 0.96385902 | 0.997755331 | 0.951566952 | 0.817515818 | 0.610884354 | 0.742040816 | 0.614965986 |
| 324 | NM_018285 | IMP3 | 0.96385902 | 0.997755331 | 0.951566952 | 0.817515818 | 0.610884354 | 0.742040816 | 0.614965986 |
| 3 | NM_004666 | VNN1 | 0.979241338 | 0.996632997 | 0.972934473 | 0.663003663 | 0.648979592 | 0.710204082 | 0.575510204 |
| 322 | NM_004666 | VNN1 | 0.979241338 | 0.996632997 | 0.972934473 | 0.663003663 | 0.648979592 | 0.710204082 | 0.575510204 |
| 26 | NM_006459 | ERLIN1 | 0.964755078 | 0.994949495 | 0.953805454 | 0.694971695 | 0.561904762 | 0.639183673 | 0.594557823 |
| 344 | NM_006459 | ERLIN1 | 0.964755078 | 0.994949495 | 0.953805454 | 0.694971695 | 0.561904762 | 0.639183673 | 0.594557823 |
| 17 | NM_207113 | SLC37A3 | 0.954301075 | 0.99382716 | 0.93996744 | 0.582417582 | 0.619047619 | 0.653061224 | 0.551020408 |
| 335 | NM_207113 | SLC37A3 | 0.954301075 | 0.99382716 | 0.93996744 | 0.582417582 | 0.619047619 | 0.653061224 | 0.551020408 |
| 38 | NM_004994 | MMP9 | 0.935782557 | 0.993265993 | 0.914936915 | 0.625374625 | 0.653061224 | 0.653877551 | 0.48707483 |
| 356 | NM_004994 | MMP9 | 0.935782557 | 0.993265993 | 0.914936915 | 0.625374625 | 0.653061224 | 0.653877551 | 0.48707483 |
| 120 | NM_004244 | CD163 | 0.842293907 | 0.993265993 | 0.787545788 | 0.716949717 | 0.481632653 | 0.663673469 | 0.648979592 |
| 433 | NM_004244 | CD163 | 0.842293907 | 0.993265993 | 0.787545788 | 0.716949717 | 0.481632653 | 0.663673469 | 0.648979592 |
| 46 | NM_006212 | PFKFB2 | 0.922341697 | 0.992704826 | 0.896825397 | 0.678654679 | 0.51292517 | 0.679183673 | 0.68707483 |
| 363 | NM_006212 | PFKFB2 | 0.922341697 | 0.992704826 | 0.896825397 | 0.678654679 | 0.51292517 | 0.679183673 | 0.68707483 |

TABLE 14

Healthy versus ipSIRS Area Under Curve (AUC)

| SEQ ID Number | Database ID | Gene Name | HC vs. Sick AUC | HC vs. inSIRS AUC | HC vs. ipSIRS AUC | SIRS vs. ipSIRS AUC | Mild vs. Severe AUC | Mild vs. Shock AUC | Severe vs. Shock AUC |
|---|---|---|---|---|---|---|---|---|---|
| 1 | NM_003268 | TLR5 | 0.962365591 | 0.873737374 | 0.994505495 | 0.808524809 | 0.606802721 | 0.768979592 | 0.672108844 |
| 320 | NM_003268 | TLR5 | 0.962365591 | 0.873737374 | 0.994505495 | 0.808524809 | 0.606802721 | 0.768979592 | 0.672108844 |
| 2 | NM_020406 | CD177 | 0.992980884 | 0.991582492 | 0.993487993 | 0.718281718 | 0.668027211 | 0.675102041 | 0.540136054 |
| 321 | NM_020406 | CD177 | 0.992980884 | 0.991582492 | 0.993487993 | 0.718281718 | 0.668027211 | 0.675102041 | 0.540136054 |
| 29 | NM_020370 | GPR84 | 0.974313023 | 0.92704826 | 0.991452991 | 0.738927739 | 0.496598639 | 0.608163265 | 0.623129252 |
| 347 | NM_020370 | GPR84 | 0.974313023 | 0.92704826 | 0.991452991 | 0.738927739 | 0.496598639 | 0.608163265 | 0.623129252 |
| 20 | NM_153046 | TDRD9 | 0.929062127 | 0.758136925 | 0.991045991 | 0.844488844 | 0.640816327 | 0.734693878 | 0.636734694 |
| 338 | NM_153046 | TDRD9 | 0.929062127 | 0.758136925 | 0.991045991 | 0.844488844 | 0.640816327 | 0.734693878 | 0.636734694 |
| 4 | NM_016021 | UBE2J1 | 0.959677419 | 0.888327722 | 0.985551486 | 0.826173826 | 0.468027211 | 0.644897959 | 0.682993197 |
| 323 | NM_016021 | UBE2J1 | 0.959677419 | 0.888327722 | 0.985551486 | 0.826173826 | 0.468027211 | 0.644897959 | 0.682993197 |
| 11 | NR_045213 | FCGR1A | 0.954749104 | 0.87037037 | 0.985347985 | 0.77988678 | 0.612244898 | 0.492244898 | 0.621768707 |
|  | NR_045213 | FCGR1A | 0.954749104 | 0.87037037 | 0.985347985 | 0.77988678 | 0.612244898 | 0.492244898 | 0.621768707 |
| 6 | NM_002934 | RNASE2 | 0.94937276 | 0.854657688 | 0.983719984 | 0.780552781 | 0.67755102 | 0.564081633 | 0.643537415 |
| 325 | NM_002934 | RNASE2 | 0.94937276 | 0.854657688 | 0.983719984 | 0.780552781 | 0.67755102 | 0.564081633 | 0.643537415 |
| 8 | NM_004054 | C3AR1 | 0.950119474 | 0.868125701 | 0.97985348 | 0.832833833 | 0.529251701 | 0.609795918 | 0.582312925 |

TABLE 14-continued

Healthy versus ipSIRS Area Under Curve (AUC)

| SEQ ID Number | Database ID | Gene Name | HC vs. Sick AUC | HC vs. inSIRS AUC | HC vs. ipSIRS AUC | SIRS vs. ipSIRS AUC | Mild vs. Severe AUC | Mild vs. Shock AUC | Severe vs. Shock AUC |
|---|---|---|---|---|---|---|---|---|---|
| 327 | NM_004054 | C3AR1 | 0.950119474 | 0.868125701 | 0.97985348 | 0.832833833 | 0.529251701 | 0.609795918 | 0.582312925 |
| 12 | NM_145018 | C11orf82 | 0.873058542 | 0.580246914 | 0.979242979 | 0.947718948 | 0.619047619 | 0.650612245 | 0.555102041 |
| 330 | NM_145018 | C11orf82 | 0.873058542 | 0.580246914 | 0.979242979 | 0.947718948 | 0.619047619 | 0.650612245 | 0.555102041 |
| 13 | NM_018099 | FAR2 | 0.942502987 | 0.843434343 | 0.978428978 | 0.794205794 | 0.561904762 | 0.746122449 | 0.693877551 |
| 331 | NM_018099 | FAR2 | 0.942502987 | 0.843434343 | 0.978428978 | 0.794205794 | 0.561904762 | 0.746122449 | 0.693877551 |

Example 5

Figure 13:
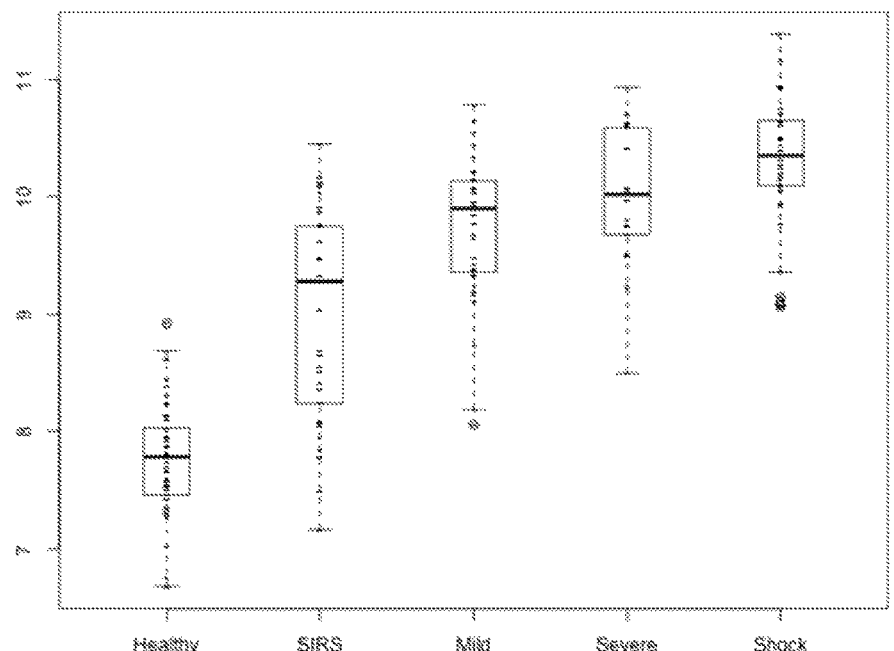
FIG. 13 shows a box and whiskers plot of TLR5 gene expression for healthy subjects and subjects with SIRS, mild sepsis, severe sepsis.
Figure 14:
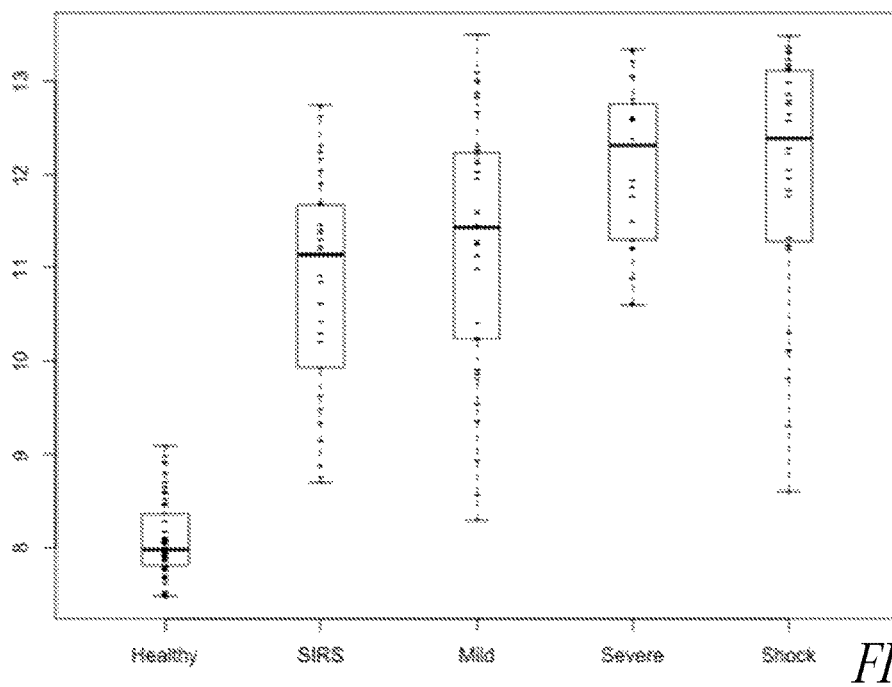
FIG. 14 shows a box and whiskers plot of CD177 gene expression for healthy subjects and subjects with SIRS, mild sepsis, severe sepsis.
Figure 15:
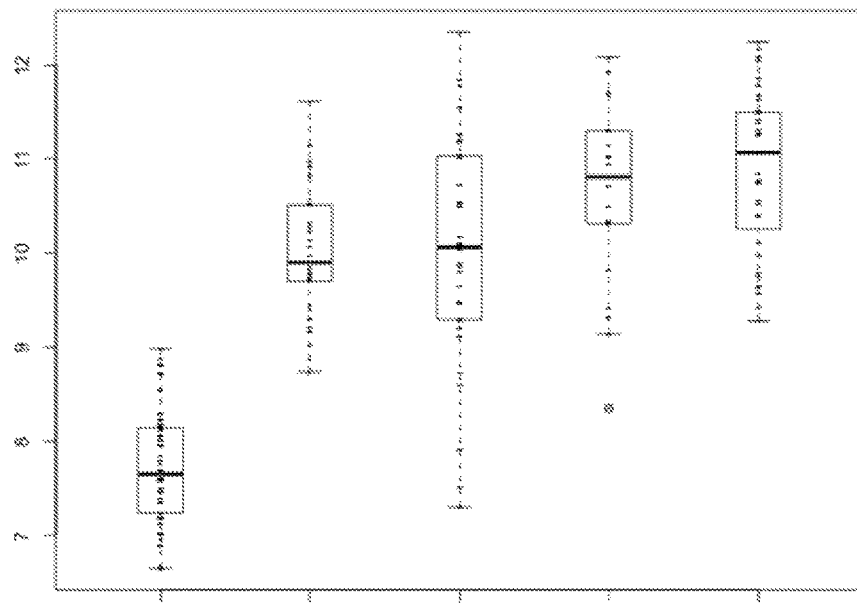
FIG. 15 shows a box and whiskers plot of VNN1 gene expression for healthy subjects and subjects with SIRS, mild sepsis, severe sepsis.
Figure 16:
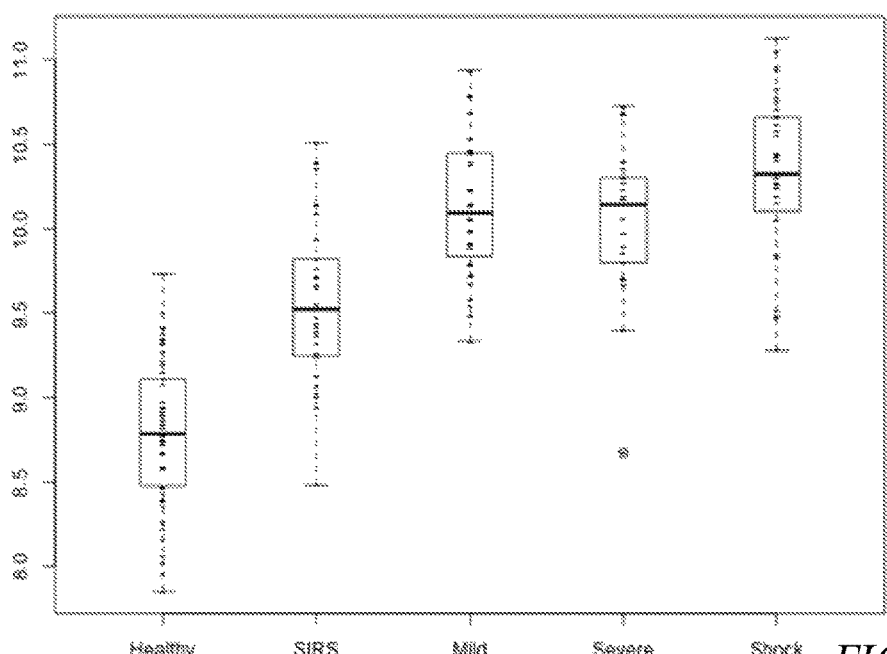
FIG. 16 shows a box and whiskers plot of UBE2J1 gene expression for healthy subjects and subjects with SIRS, mild sepsis, severe sepsis.
Figure 17:
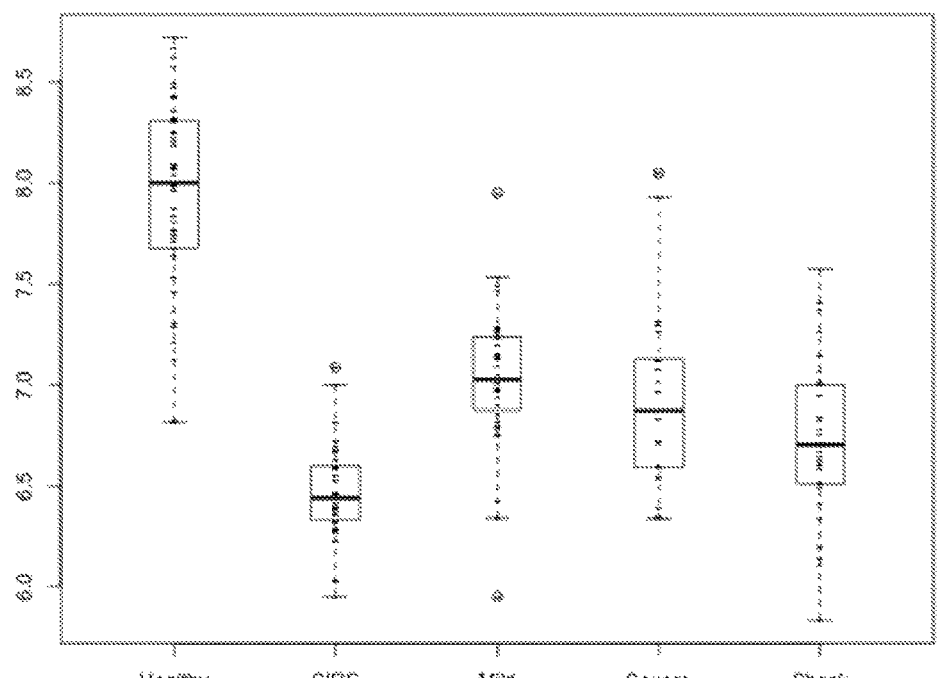
FIG. 17 shows a box and whiskers plot of IMP3 gene expression for healthy subjects and subjects with SIRS, mild sepsis, severe sepsis.
Figure 18:
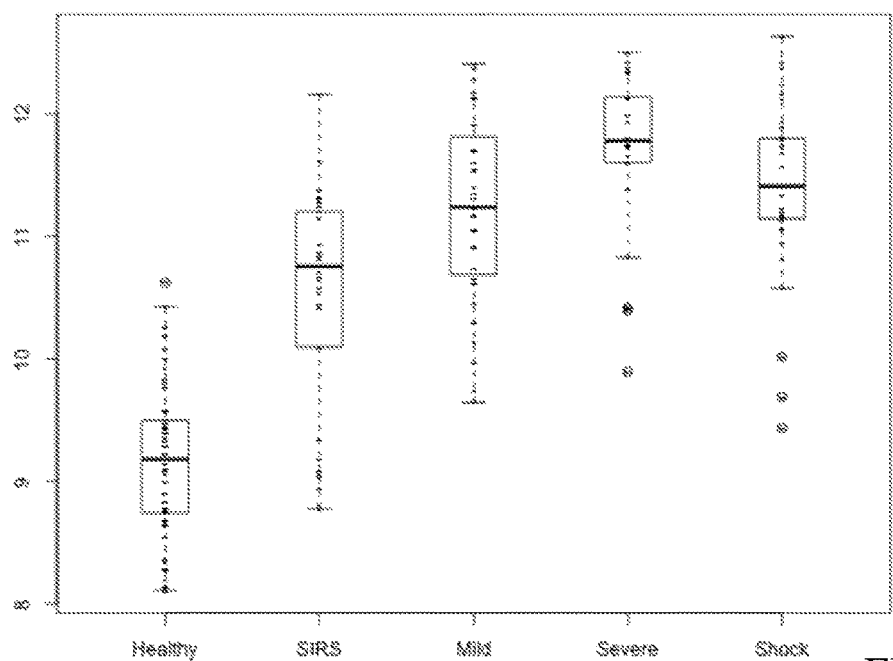
FIG. 18 shows a box and whiskers plot of RNASE2//LOC643332 gene expression for healthy subjects and subjects with SIRS, mild sepsis, severe sepsis.
Figure 19:
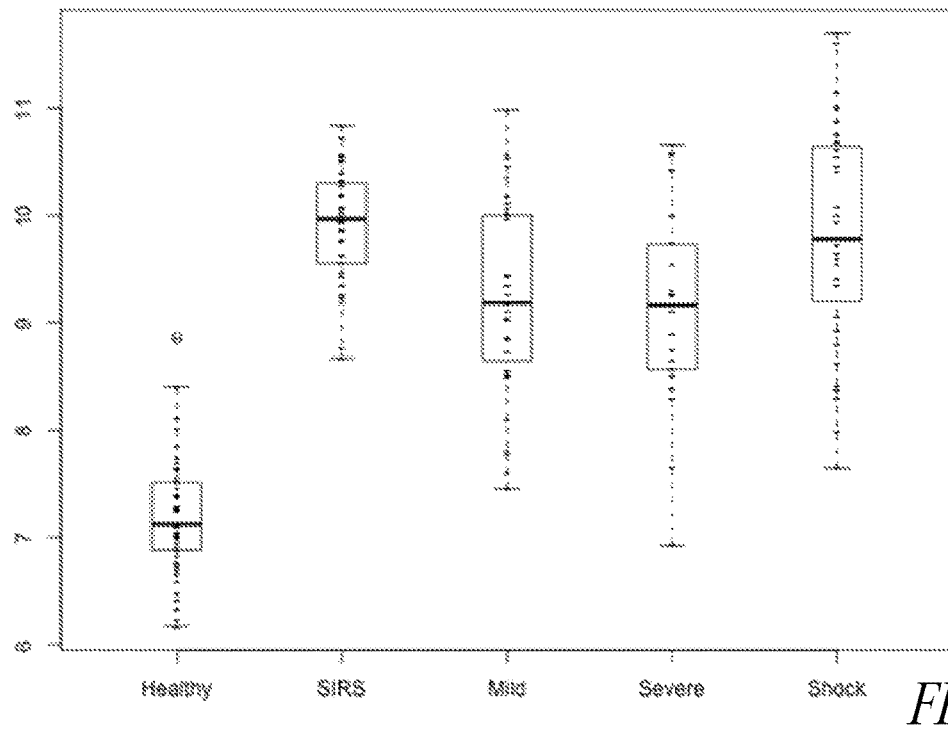
FIG. 19 shows a box and whiskers plot of CLEC4D gene expression for healthy subjects and subjects with SIRS, mild sepsis, severe sepsis.
Figure 20:
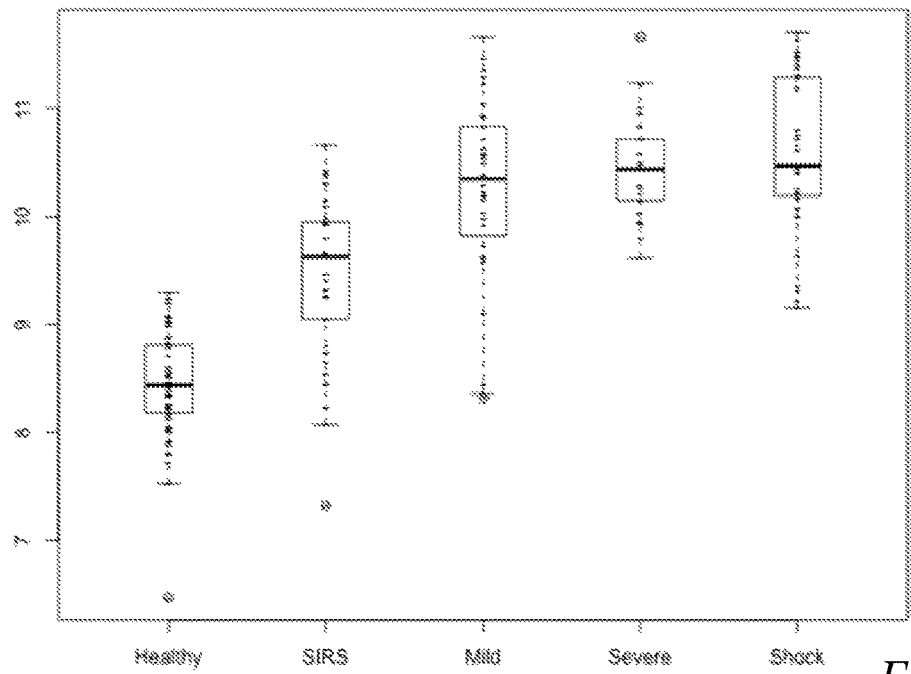
FIG. 20 shows a box and whiskers plot of C3AR1 gene expression for healthy subjects and subjects with SIRS, mild sepsis, severe sepsis.
Figure 21:
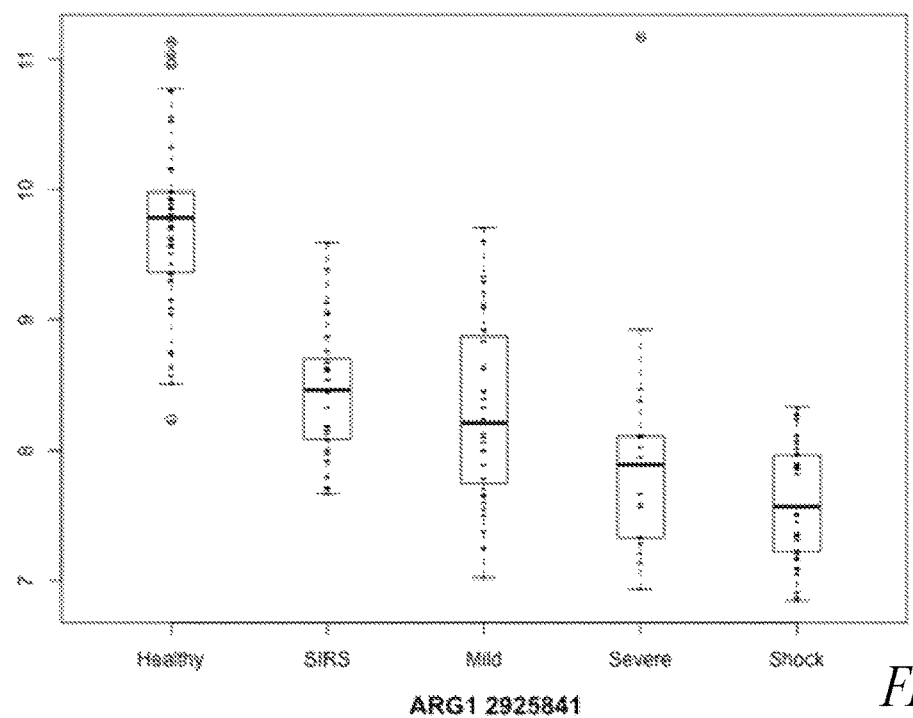
FIG. 21 shows a box and whiskers plot of GPR56 gene expression for healthy subjects and subjects with SIRS, mild sepsis, severe sepsis.
Figure 22:
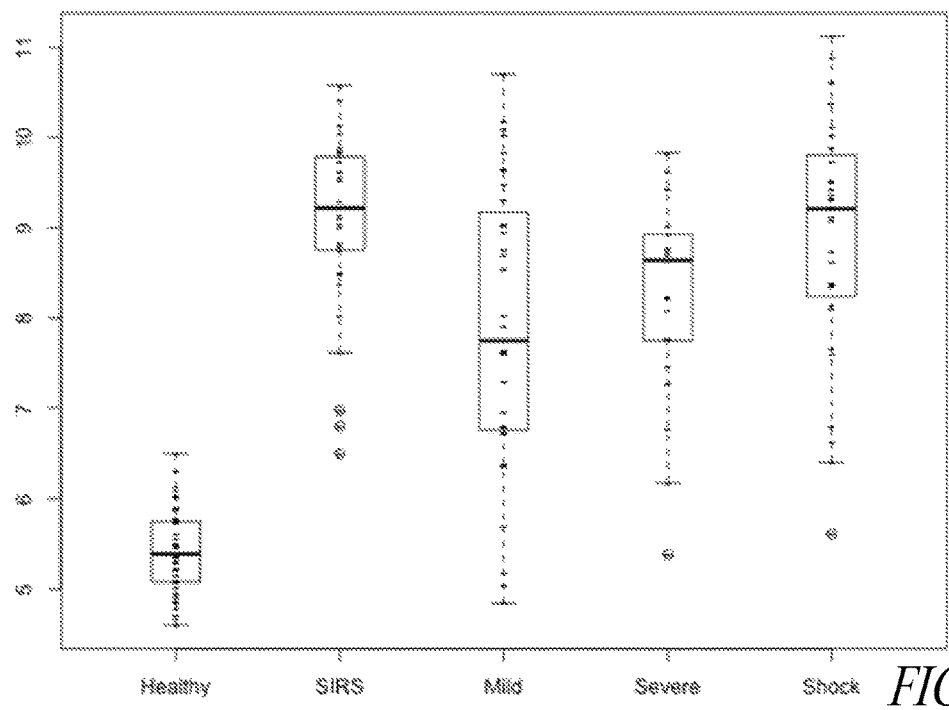
FIG. 22 shows a box and whiskers plot of ARG1 gene expression for healthy subjects and subjects with SIRS, mild sepsis, severe sepsis.
Figure 23:
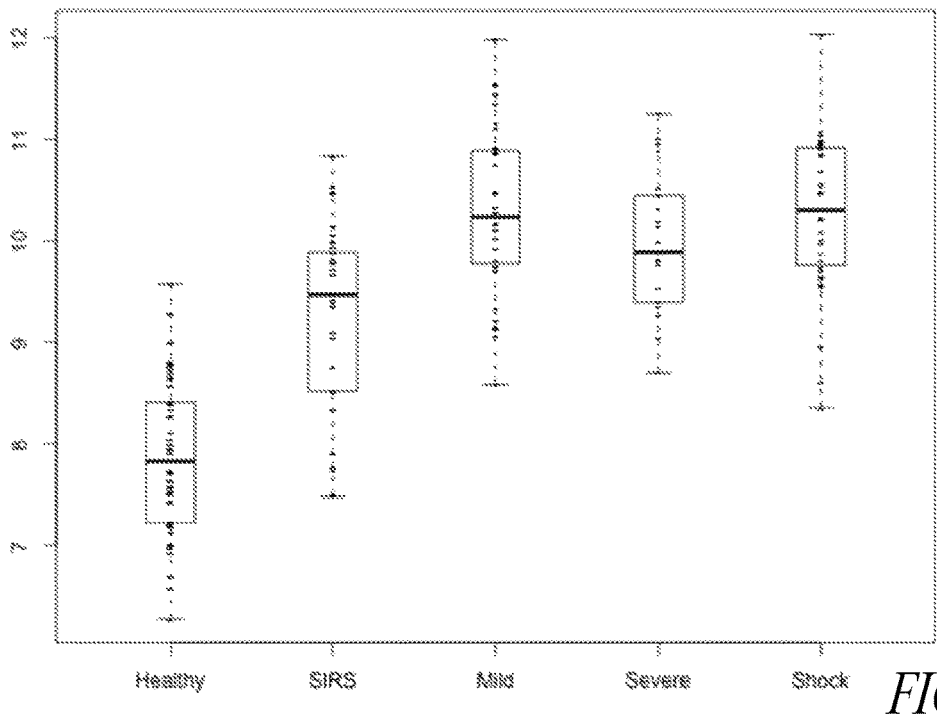
FIG. 23 shows a box and whiskers plot of FCGR1A//FCGR1B//FCGR1C gene expression for healthy subjects and subjects with SIRS, mild sepsis, severe sepsis.
Figure 24:
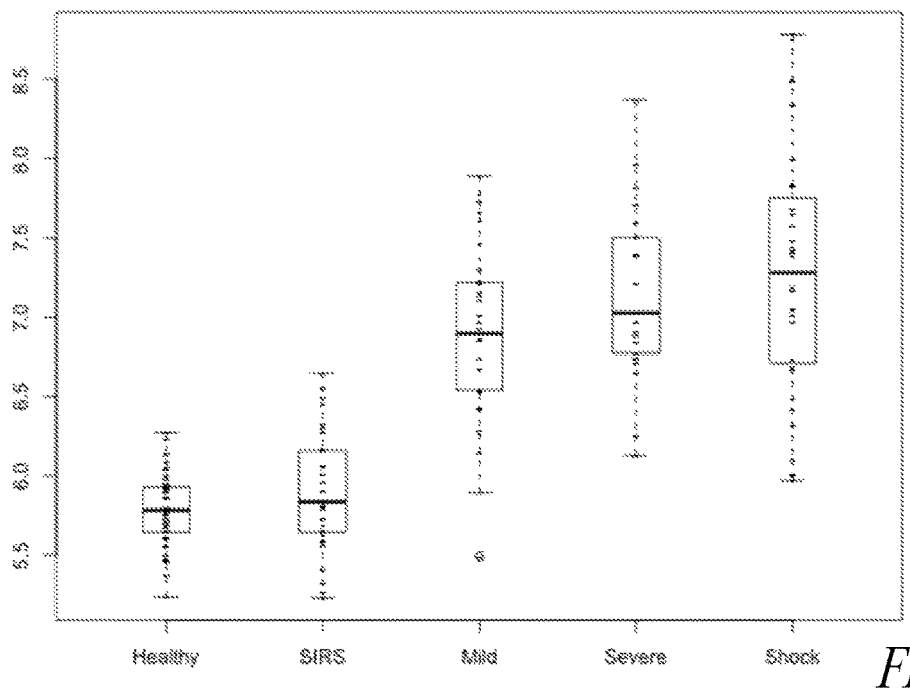
FIG. 24 shows a box and whiskers plot of C11orf82 gene expression for healthy subjects and subjects with SIRS, mild sepsis, severe sepsis.
Figure 25:
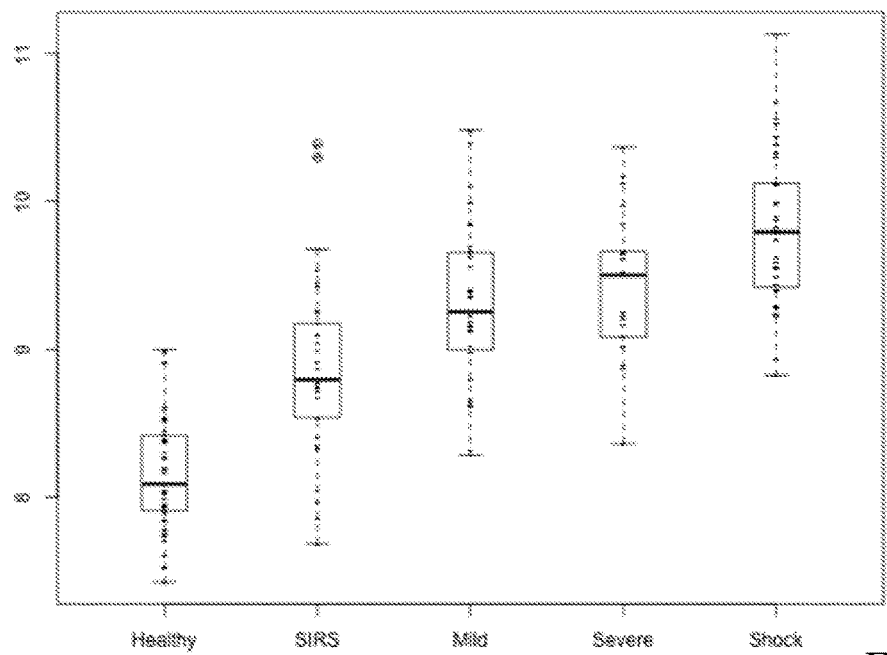
FIG. 25 shows a box and whiskers plot of FAR2 gene expression for healthy subjects and subjects with SIRS, mild sepsis, severe sepsis.
Figure 26:
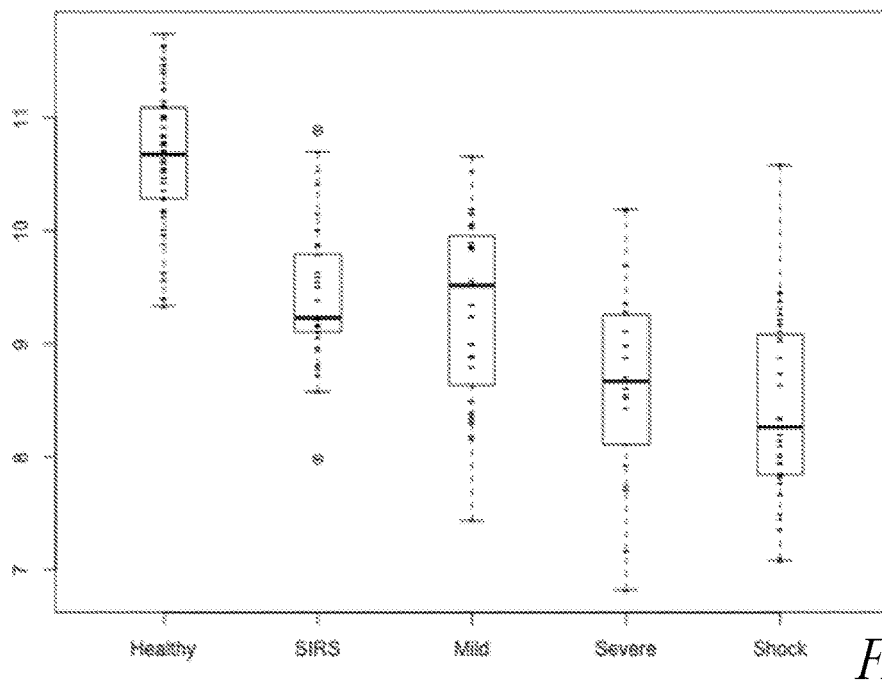
FIG. 26 shows a box and whiskers plot of GNLY gene expression for healthy subjects and subjects with SIRS, mild sepsis, severe sepsis.
Figure 27:
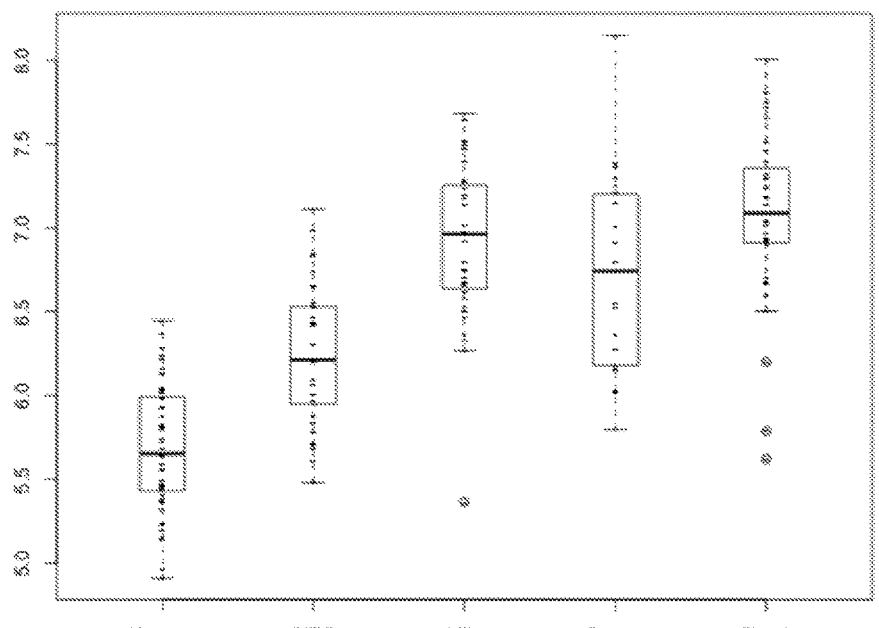
FIG. 27 shows a box and whiskers plot of GALNT3 gene expression for healthy subjects and subjects with SIRS, mild sepsis, severe sepsis.
Figure 28:
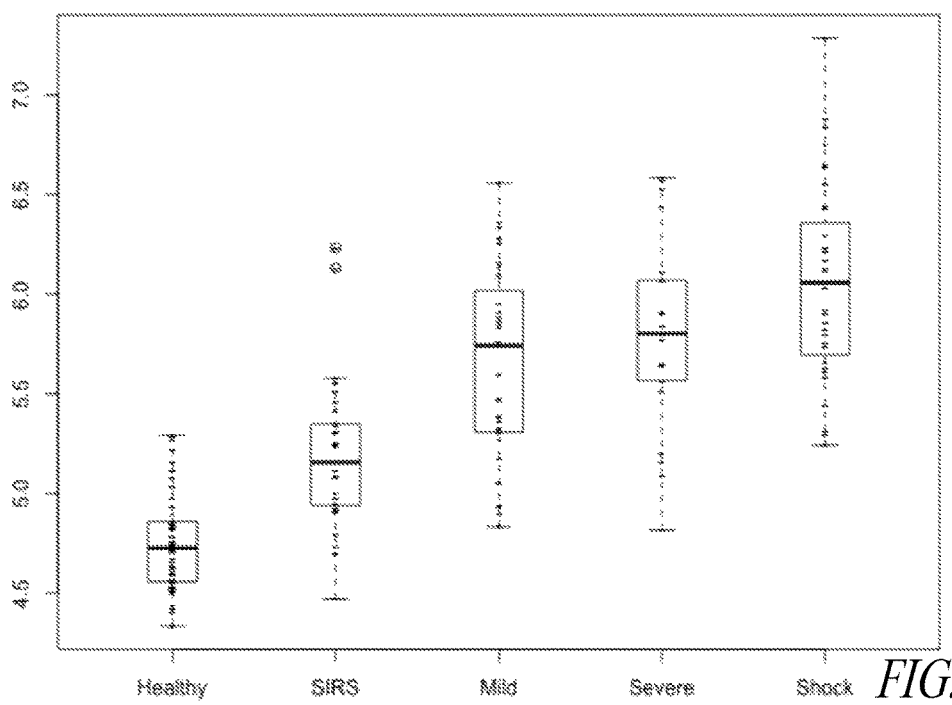
FIG. 28 shows a box and whiskers plot of OMG gene expression for healthy subjects and subjects with SIRS, mild sepsis, severe sepsis.
Figure 29:
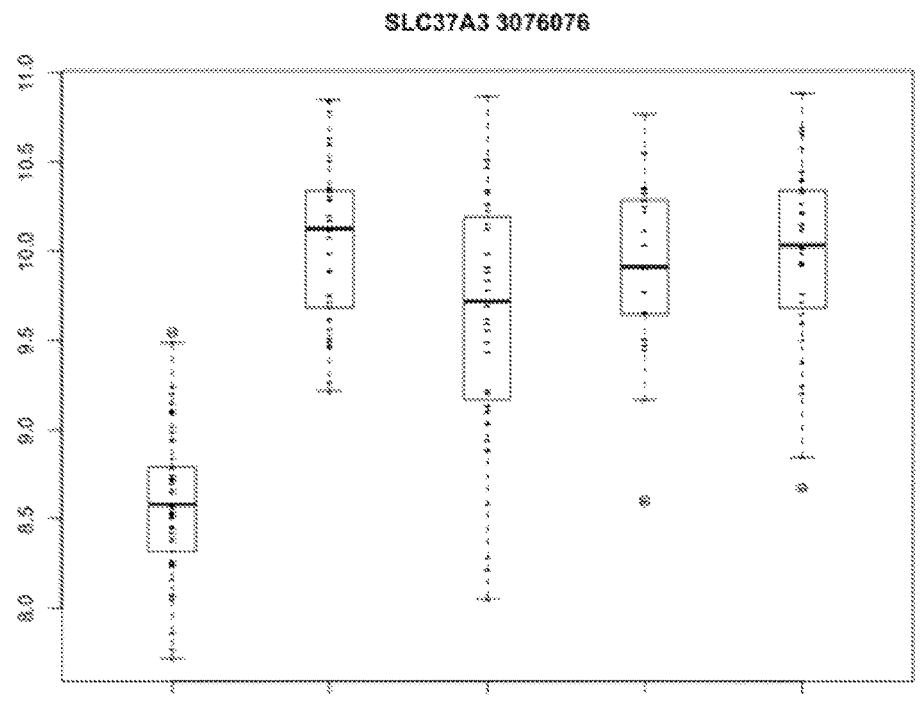
FIG. 29 shows a box and whiskers plot of SLC37A3 gene expression for healthy subjects and subjects with SIRS, mild sepsis, severe sepsis.
Figure 30:
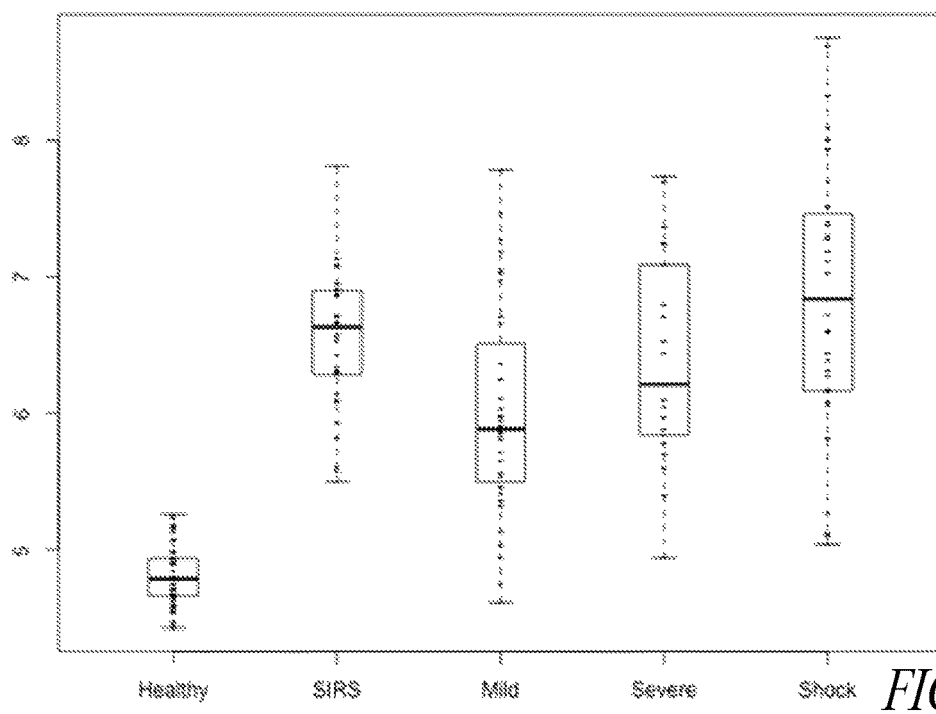
FIG. 30 shows a box and whiskers plot of BMX//HNRPDL gene expression for healthy subjects and subjects with SIRS, mild sepsis, severe sepsis.
Figure 31:
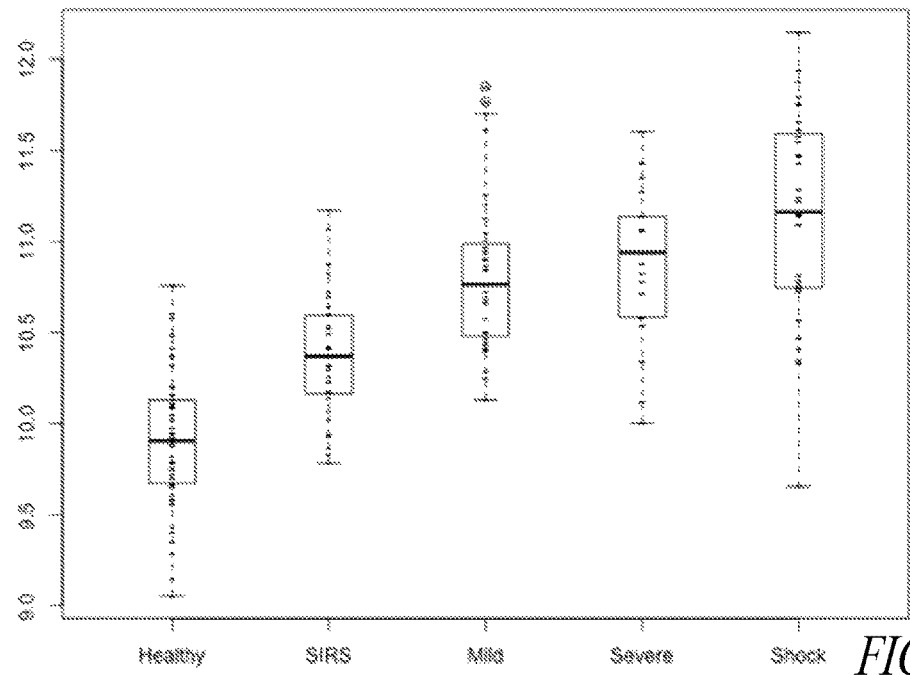
FIG. 31 shows a box and whiskers plot of STOM gene expression for healthy subjects and subjects with SIRS, mild sepsis, severe sepsis.
Figure 32:
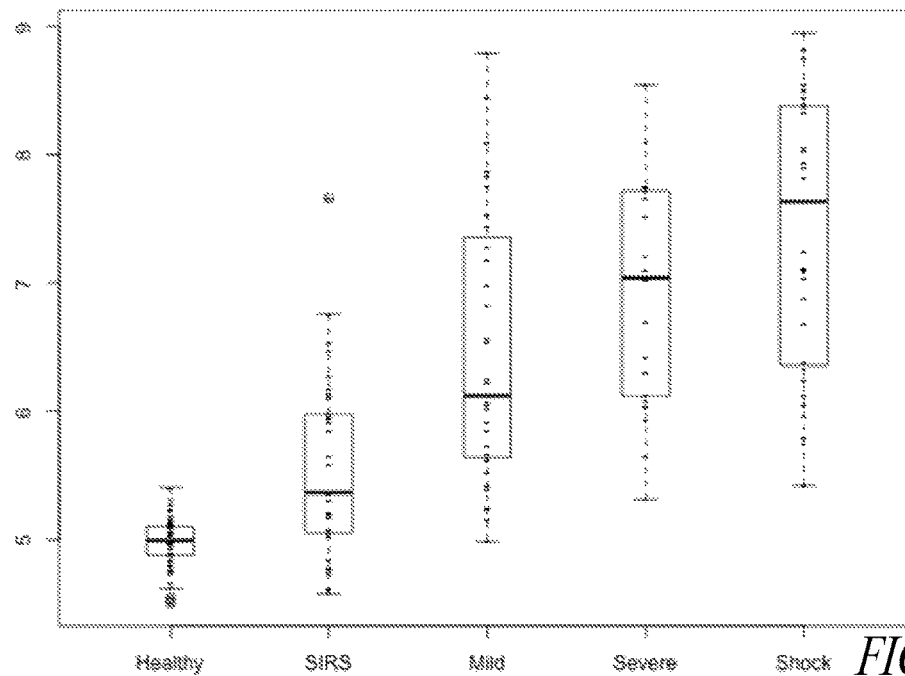
FIG. 32 shows a box and whiskers plot of TDRD9 gene expression for healthy subjects and subjects with SIRS, mild sepsis, severe sepsis.
Figure 33:
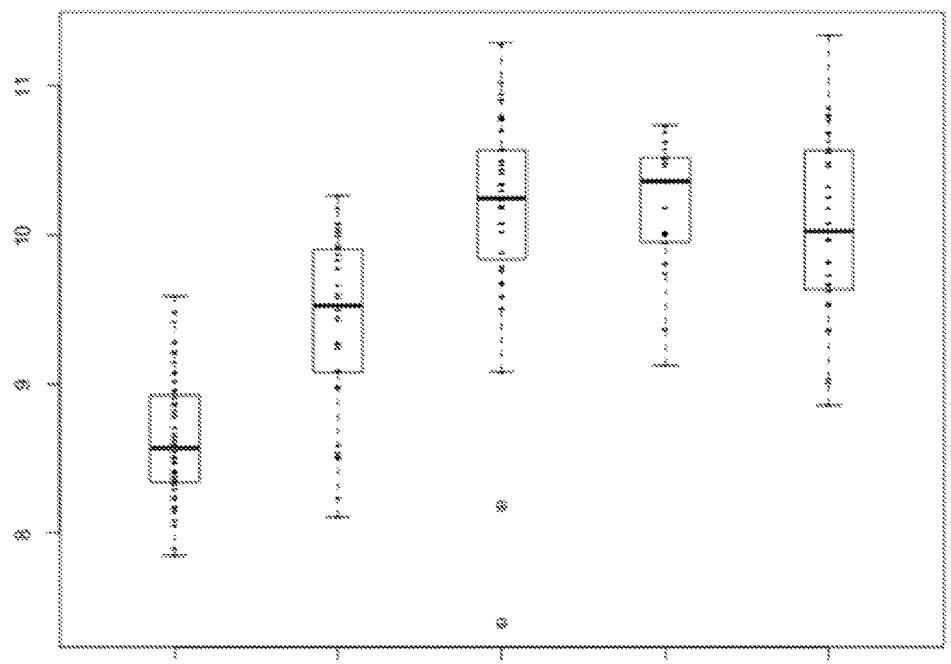
FIG. 33 shows a box and whiskers plot of KREMEN1 gene expression for healthy subjects and subjects with SIRS, mild sepsis, severe sepsis.
Figure 34:
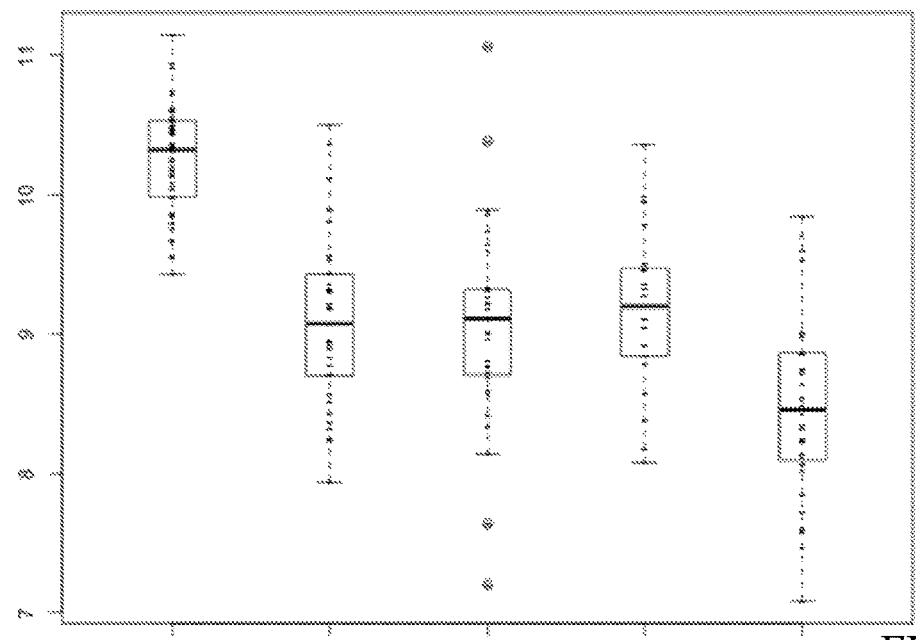
FIG. 34 shows a box and whiskers plot of FAIM3 gene expression for healthy subjects and subjects with SIRS, mild sepsis, severe sepsis.
Figure 35:
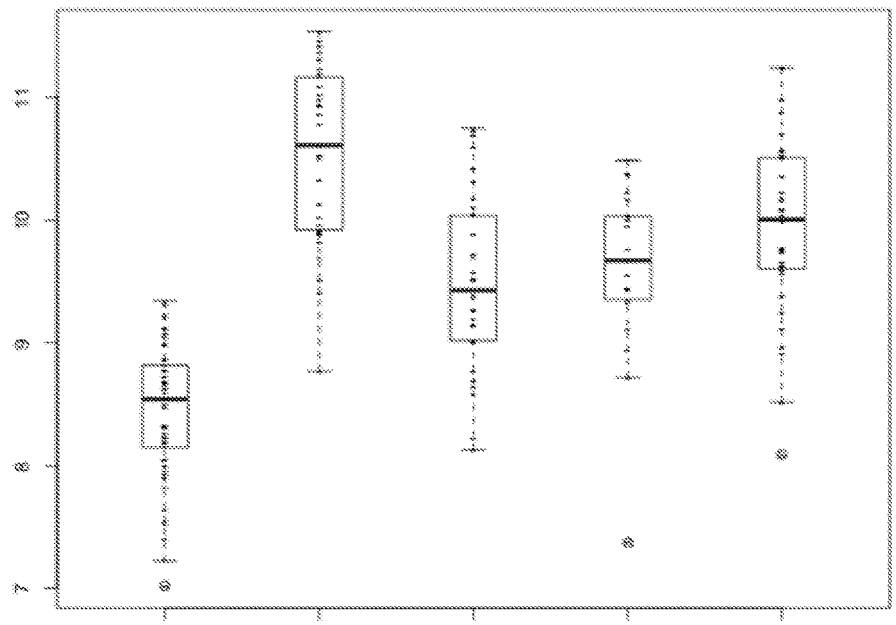
FIG. 35 shows a box and whiskers plot of CLEC4E gene expression for healthy subjects and subjects with SIRS, mild sepsis, severe sepsis.
Figure 36:
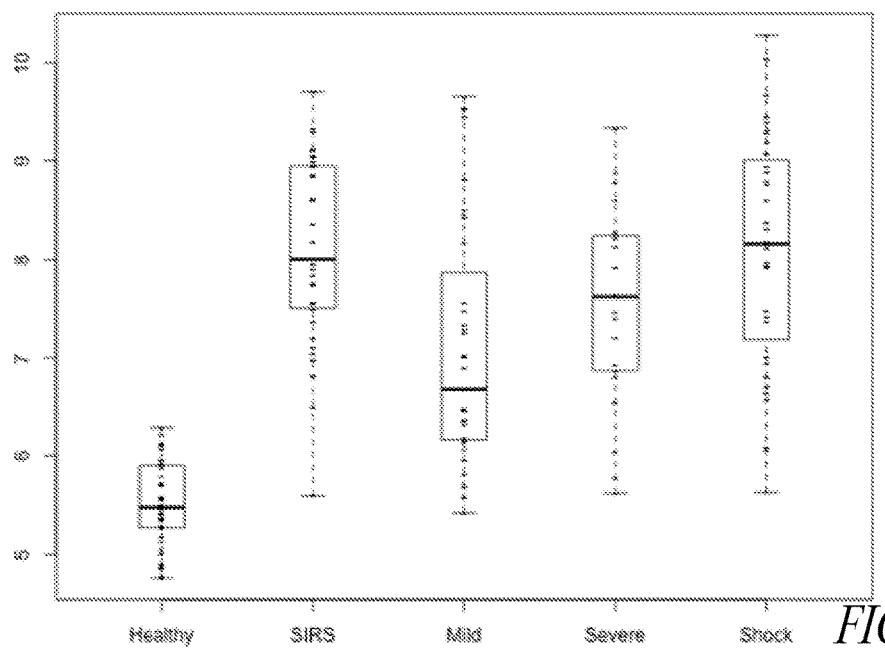
FIG. 36 shows a box and whiskers plot of IL18R1 gene expression for healthy subjects and subjects with SIRS, mild sepsis, severe sepsis.
Figure 37:
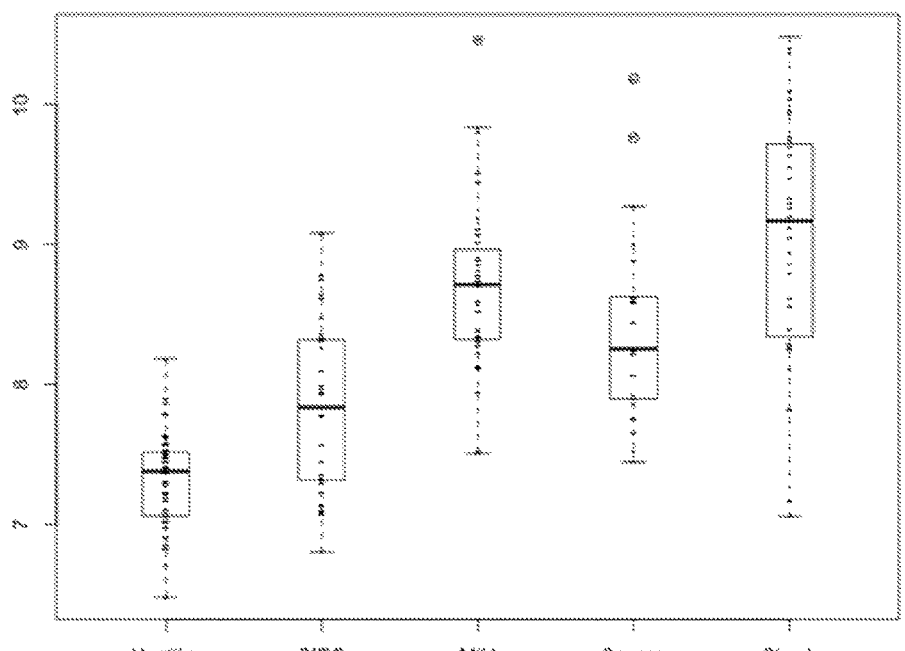
FIG. 37 shows a box and whiskers plot of ACER3 gene expression for healthy subjects and subjects with SIRS, mild sepsis, severe sepsis.
Figure 38:
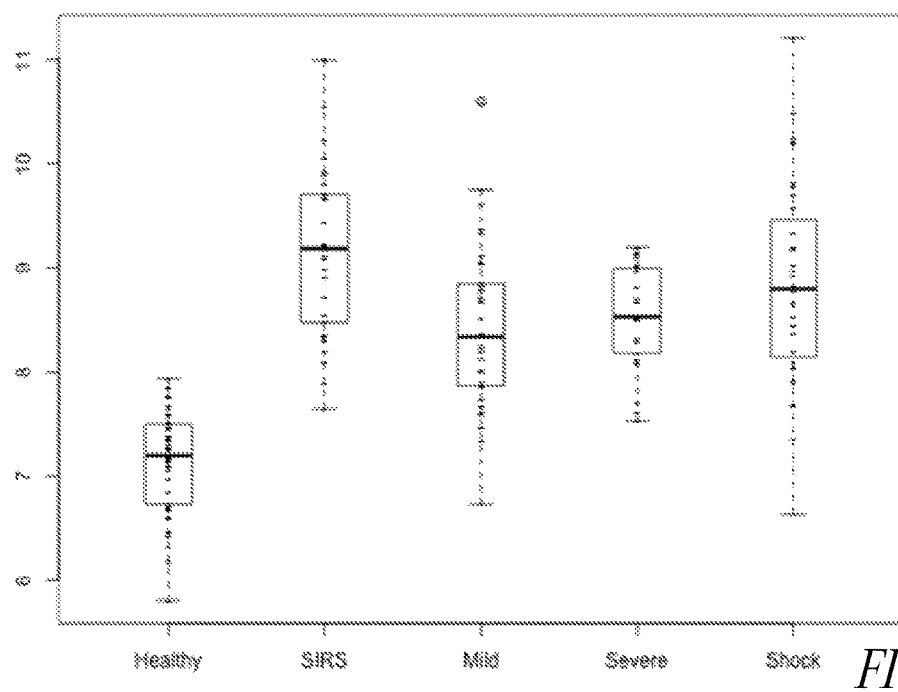
FIG. 38 shows a box and whiskers plot of ERLIN1 gene expression for healthy subjects and subjects with SIRS, mild sepsis, severe sepsis.
Figure 39:
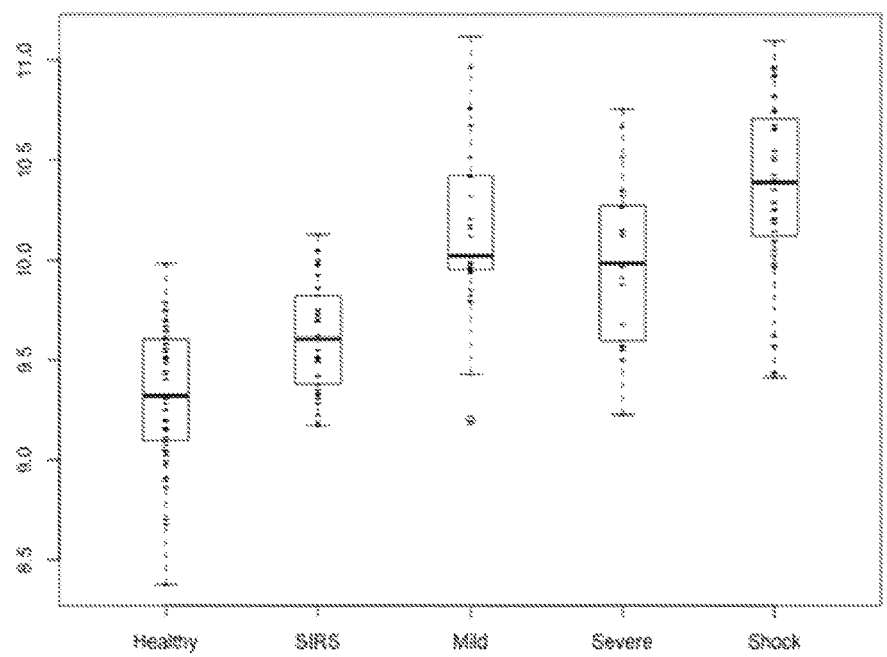
FIG. 39 shows a box and whiskers plot of TGFBR1 gene expression for healthy subjects and subjects with SIRS, mild sepsis, severe sepsis.
Figure 40:
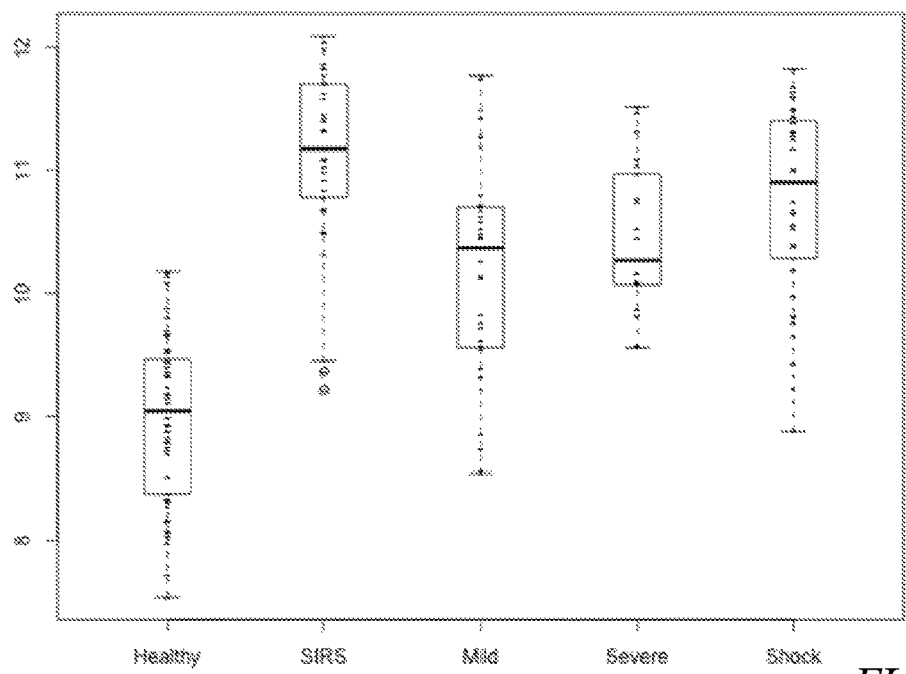
FIG. 40 shows a box and whiskers plot of FKBP5//LOC285847 gene expression for healthy subjects and subjects with SIRS, mild sepsis, severe sepsis.
Figure 41:
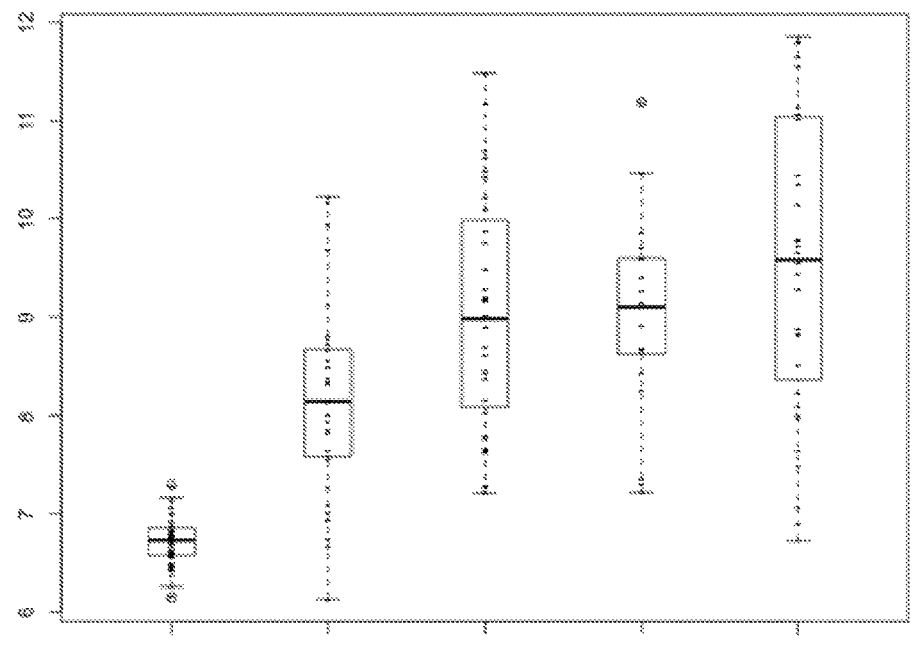
FIG. 41 shows a box and whiskers plot of GPR84 gene expression for healthy subjects and subjects with SIRS, mild sepsis, severe sepsis.
Figure 42:
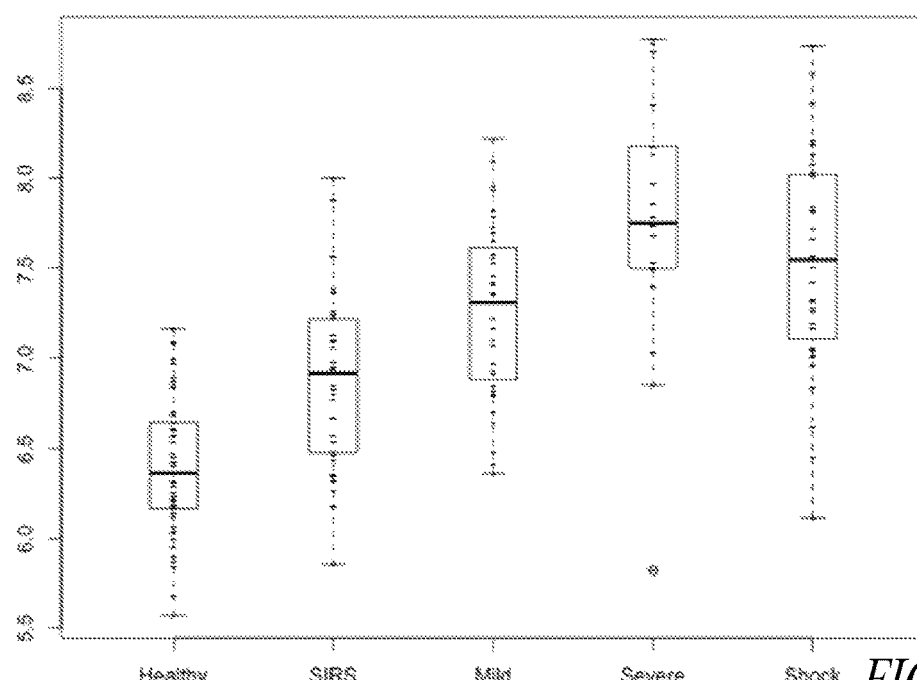
FIG. 42 shows a box and whiskers plot of C7orf53 gene expression for healthy subjects and subjects with SIRS, mild sepsis, severe sepsis.
Figure 43:
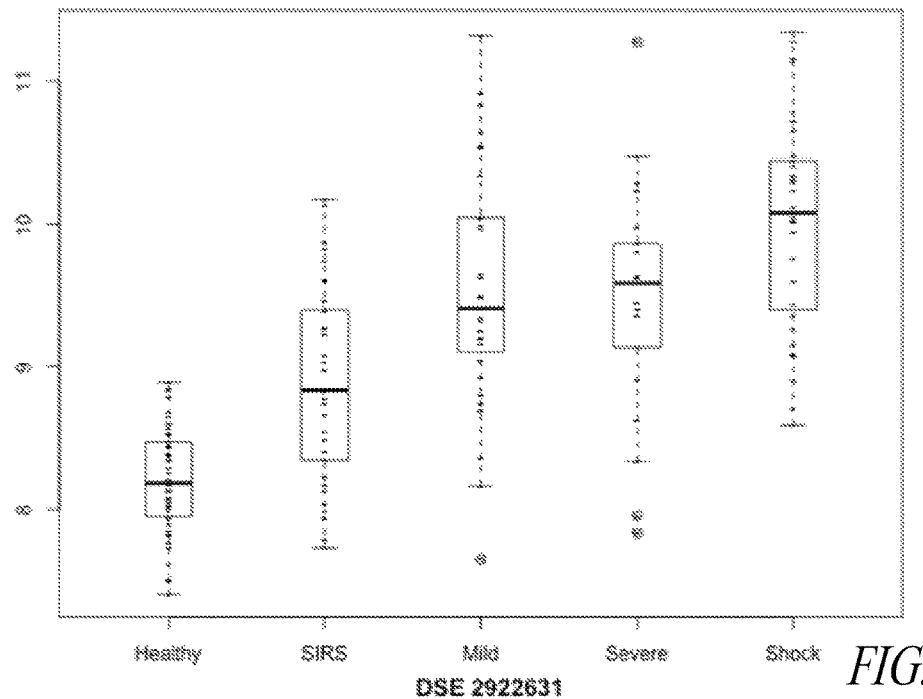
FIG. 43 shows a box and whiskers plot of PLB1 gene expression for healthy subjects and subjects with SIRS, mild sepsis, severe sepsis.
Figure 44:
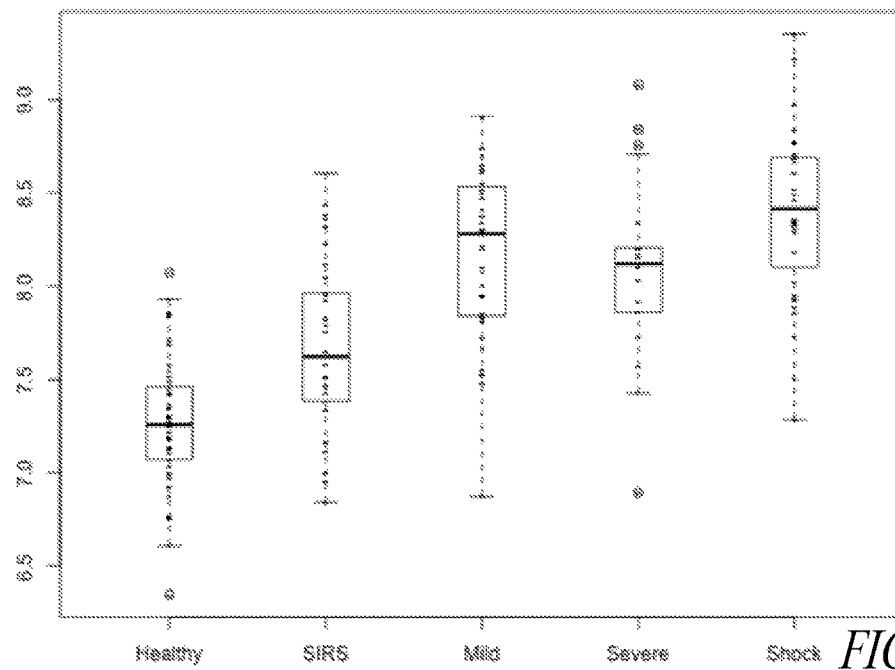
FIG. 44 shows a box and whiskers plot of DSE gene expression for healthy subjects and subjects with SIRS, mild sepsis, severe sepsis.
Figure 45:
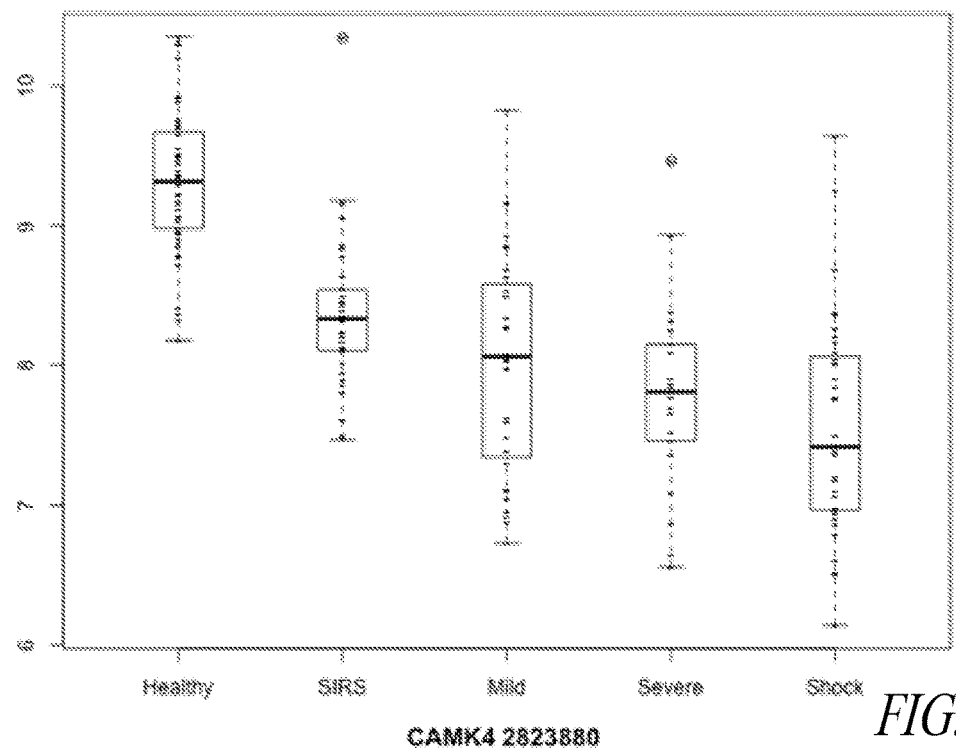
FIG. 45 shows a box and whiskers plot of PTGDR gene expression for healthy subjects and subjects with SIRS, mild sepsis, severe sepsis.
Figure 46:
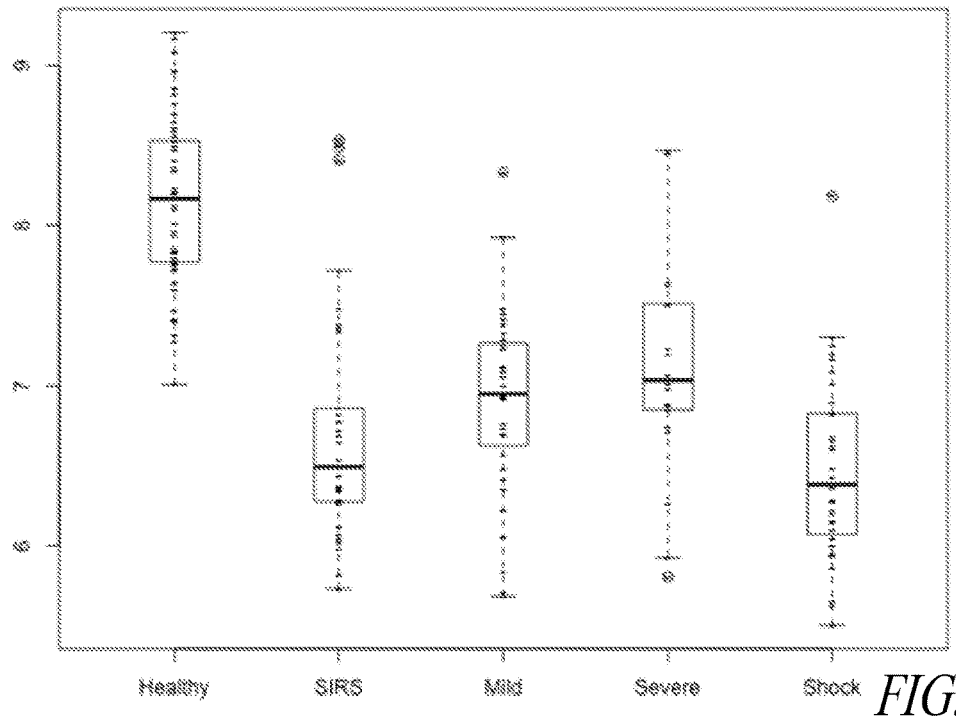
FIG. 46 shows a box and whiskers plot of CAMK4 gene expression for healthy subjects and subjects with SIRS, mild sepsis, severe sepsis.
Figure 47:
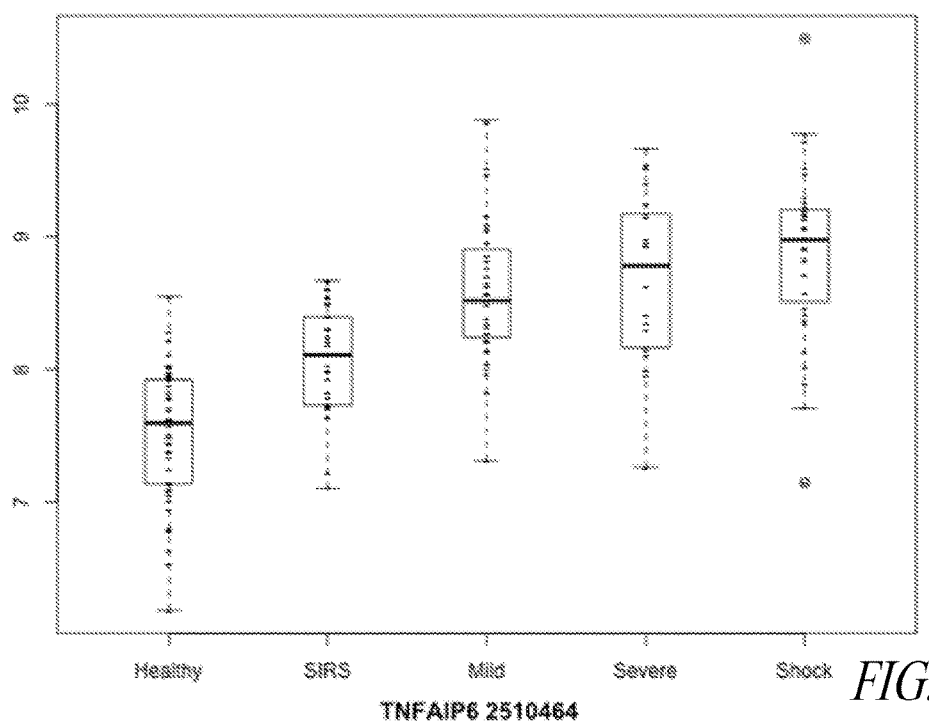
FIG. 47 shows a box and whiskers plot of DNAJC13 gene expression for healthy subjects and subjects with SIRS, mild sepsis, severe sepsis.
Figure 48:
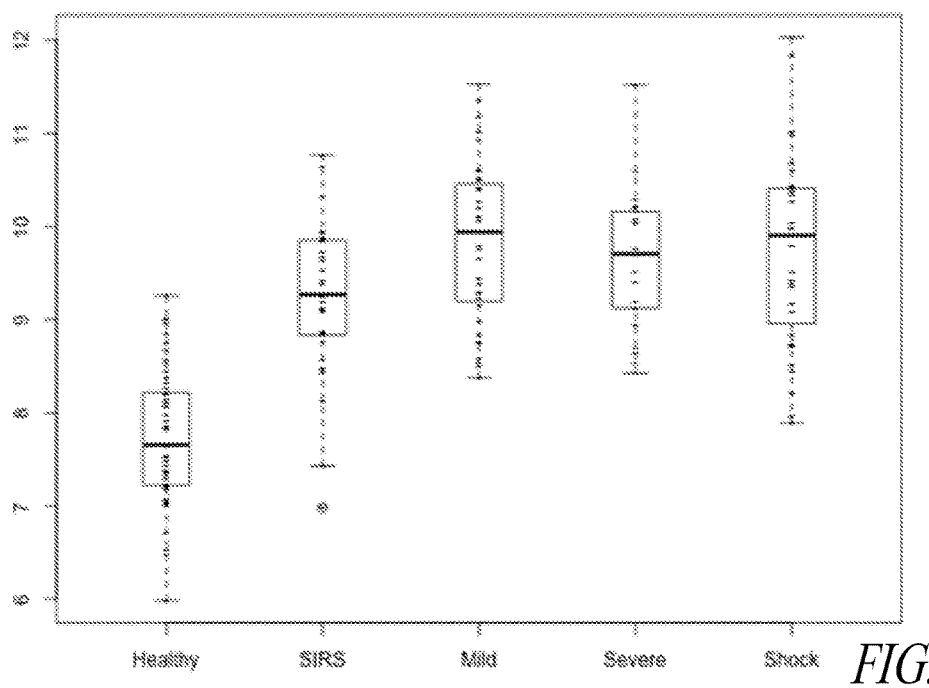
FIG. 48 shows a box and whiskers plot of TNFAIP6 gene expression for healthy subjects and subjects with SIRS, mild sepsis, severe sepsis.
Figure 49:
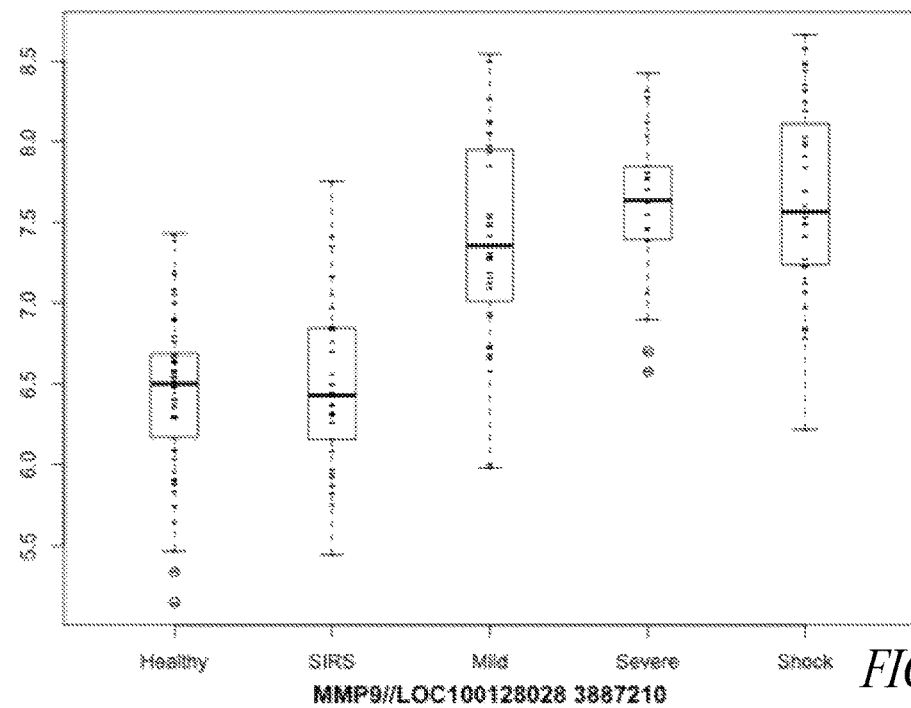
FIG. 49 shows a box and whiskers plot of FOXD4L3//FOXD4L6//FOXD4//FOXD4L1//FOXD4L2//FOXD4L4//FOXD4L5 gene expression for healthy subjects and subjects with SIRS, mild sepsis, severe sepsis.
Figure 50:
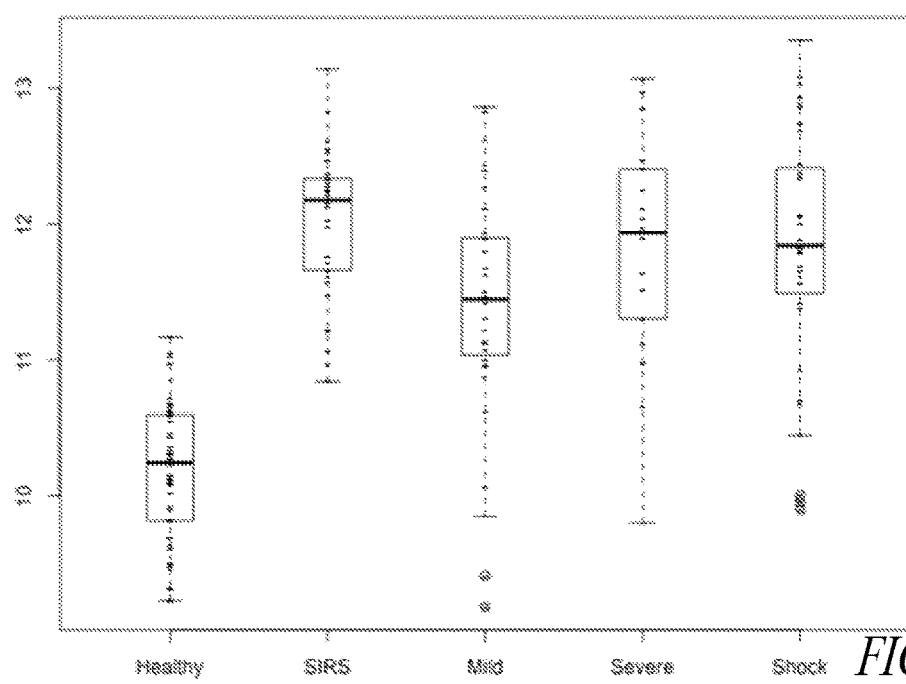
FIG. 50 shows a box and whiskers plot of MMP9//LOC100128028 gene expression for healthy subjects and subjects with SIRS, mild sepsis, severe sepsis.
Figure 51:
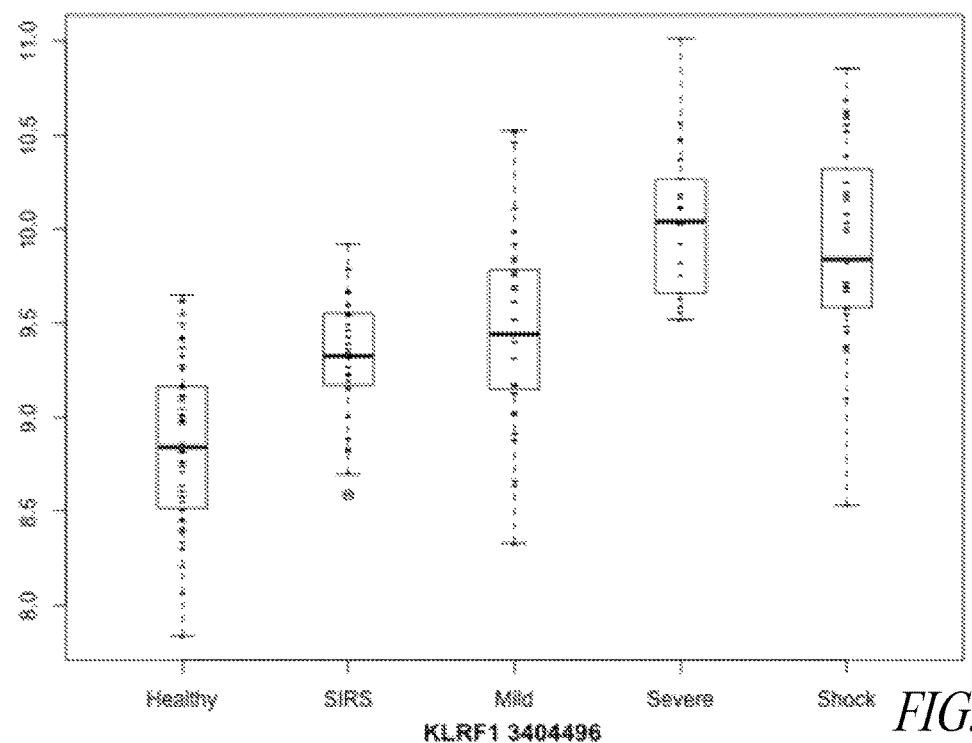
FIG. 51 shows a box and whiskers plot of GSR gene expression for healthy subjects and subjects with SIRS, mild sepsis, severe sepsis.
Figure 52:
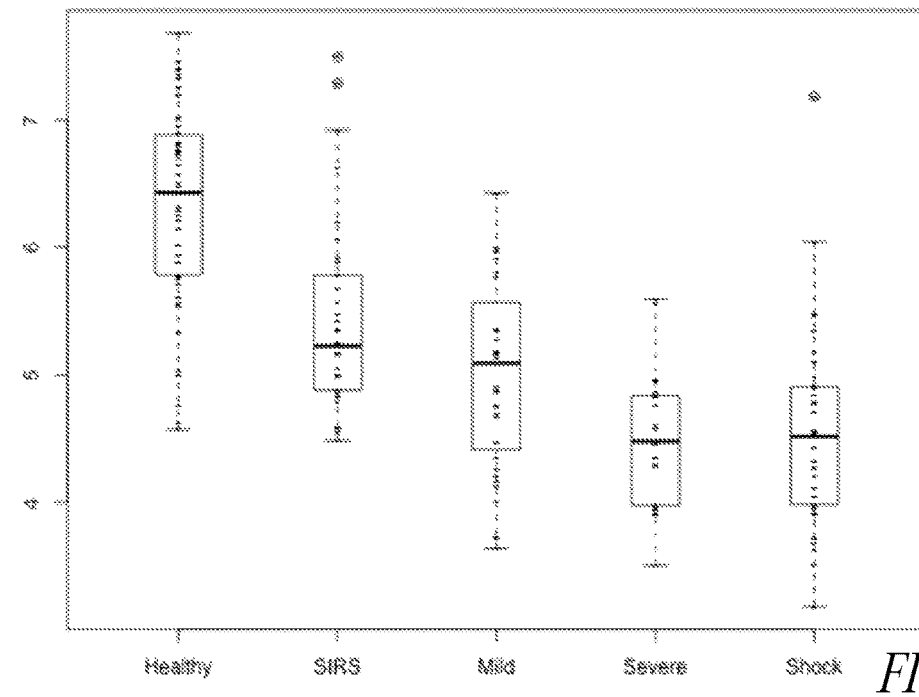
FIG. 52 shows a box and whiskers plot of KLRF1 gene expression for healthy subjects and subjects with SIRS, mild sepsis, severe sepsis.
Figure 53:
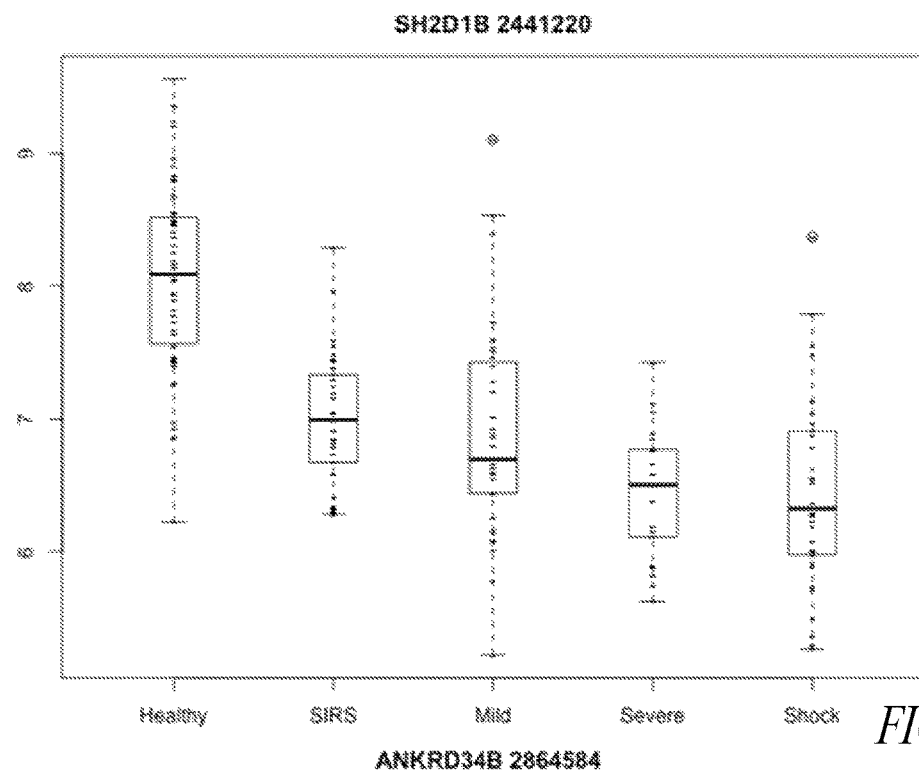
FIG. 53 shows a box and whiskers plot of SH2D1B gene expression for healthy subjects and subjects with SIRS, mild sepsis, severe sepsis.
Figure 54:
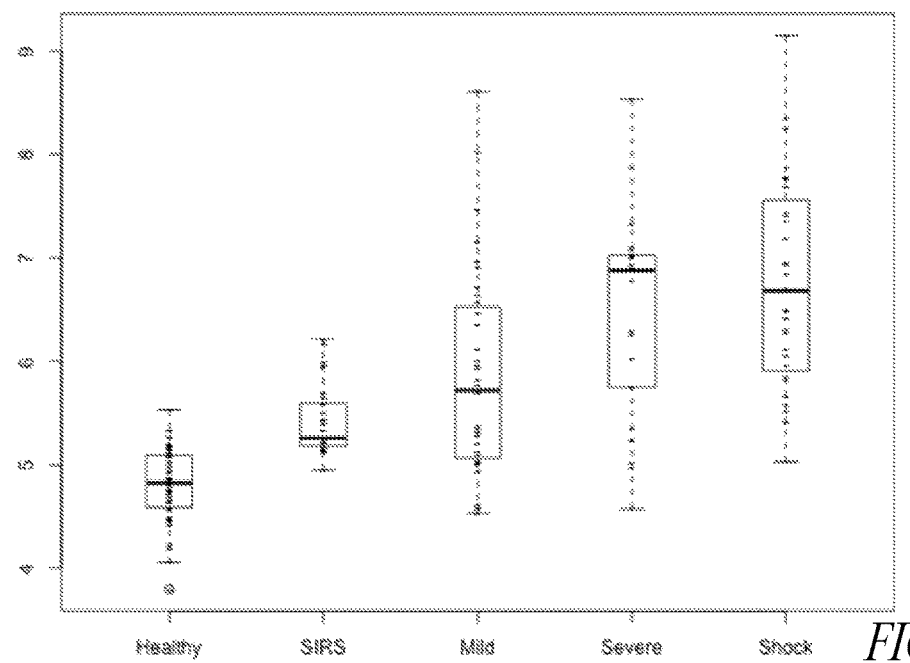
FIG. 54 shows a box and whiskers plot of ANKRD34B gene expression for healthy subjects and subjects with SIRS, mild sepsis, severe sepsis.
Figure 55:
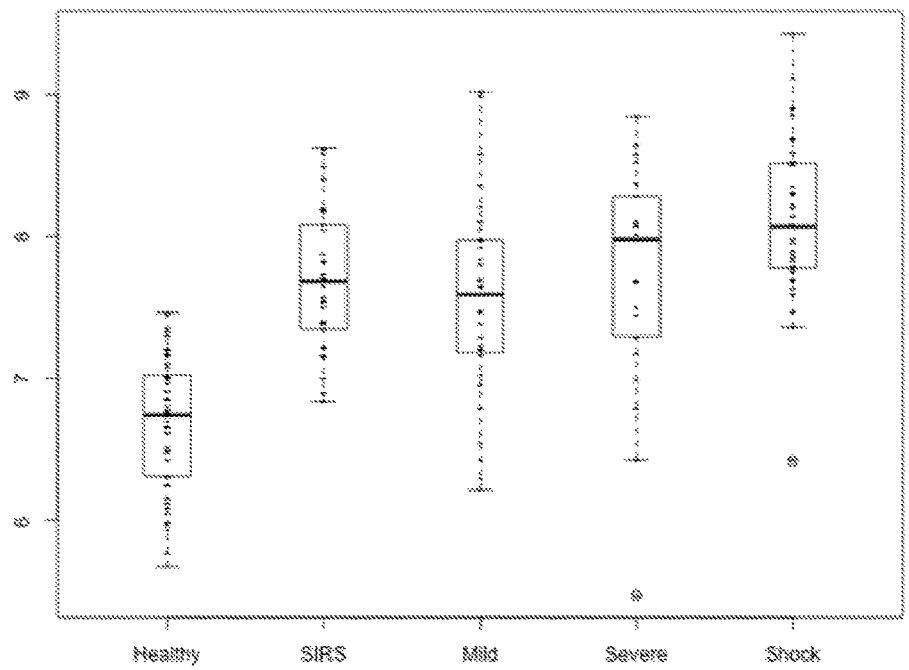
FIG. 55 shows a box and whiskers plot of SGMS2 gene expression for healthy subjects and subjects with SIRS, mild sepsis, severe sepsis.
Figure 56:
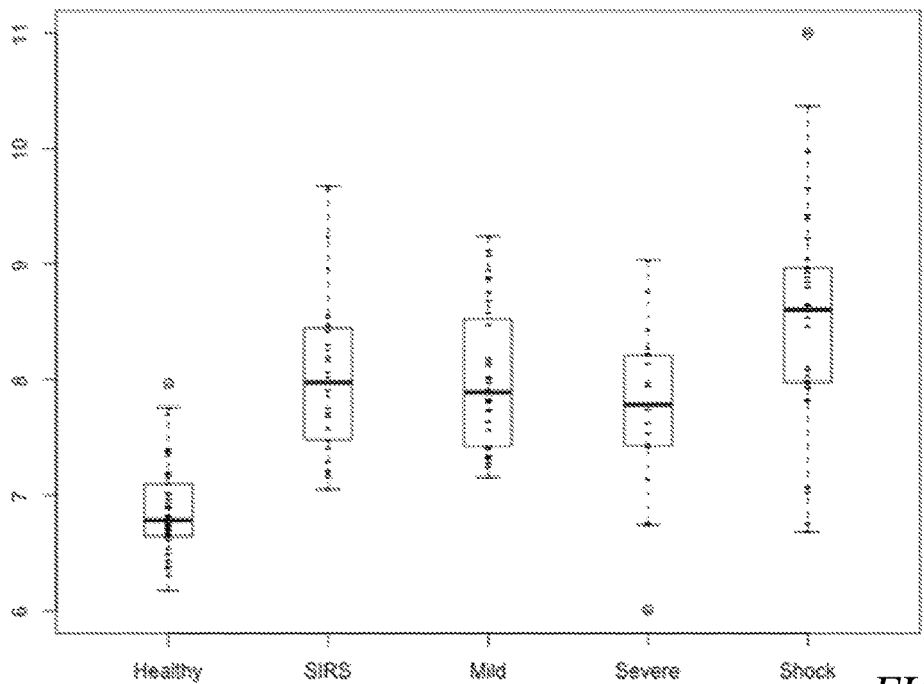
FIG. 56 shows a box and whiskers plot of B3GNT5//MCF2L2 gene expression for healthy subjects and subjects with SIRS, mild sepsis, severe sepsis.
Figure 57:
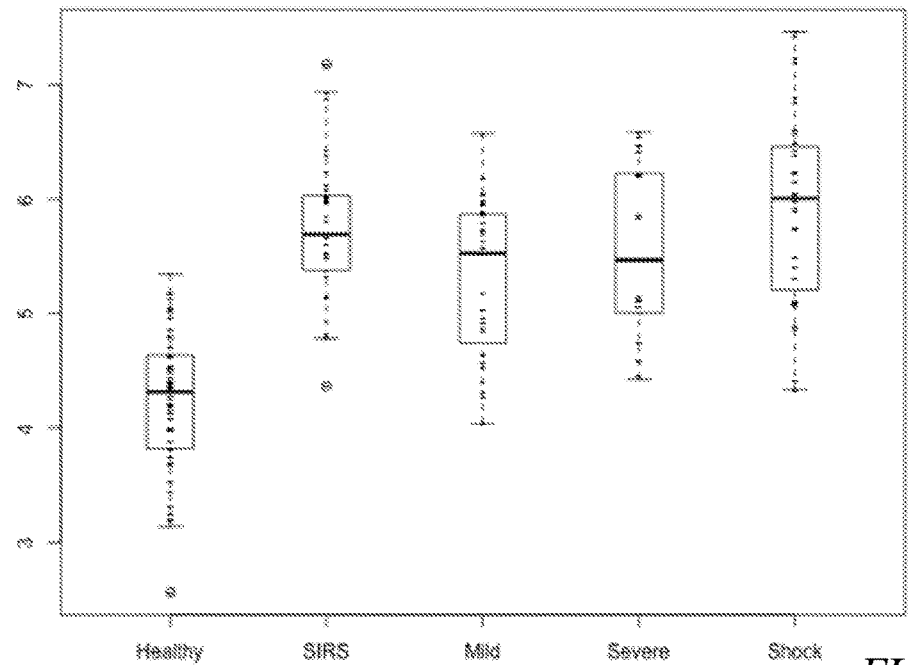
FIG. 57 shows a box and whiskers plot of GK3P//GK gene expression for healthy subjects and subjects with SIRS, mild sepsis, severe sepsis.
Figure 58:
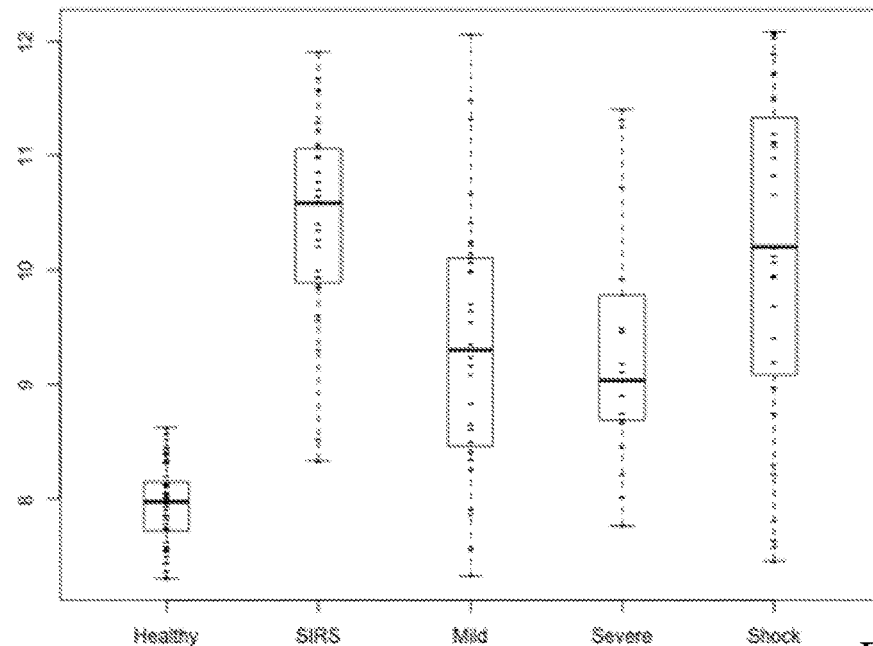
FIG. 58 shows a box and whiskers plot of PFKFB2 gene expression for healthy subjects and subjects with SIRS, mild sepsis, severe sepsis.
Figure 59:
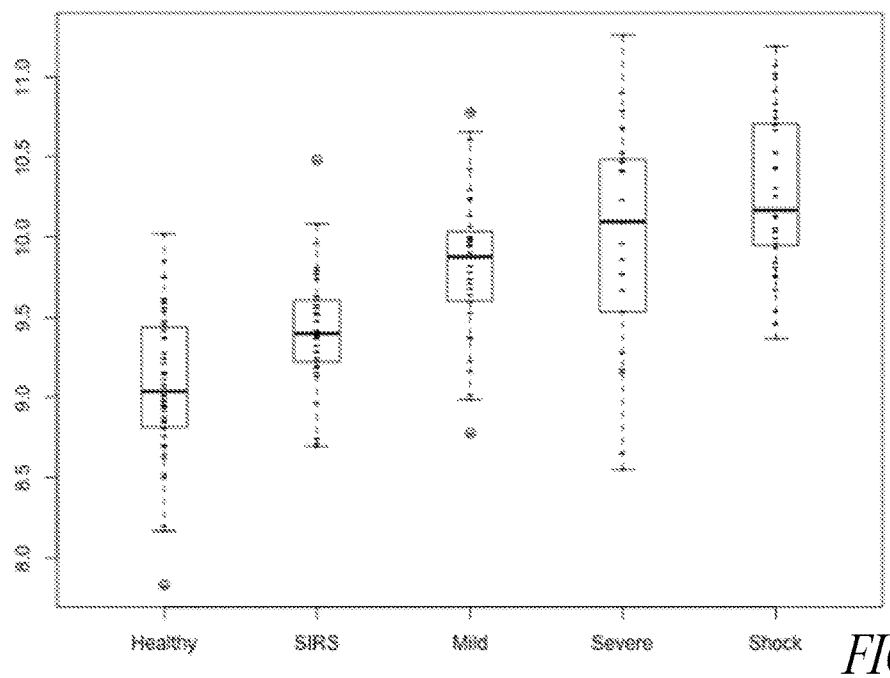
FIG. 59 shows a box and whiskers plot of PICALM gene expression for healthy subjects and subjects with SIRS, mild sepsis, severe sepsis.
Figure 60:
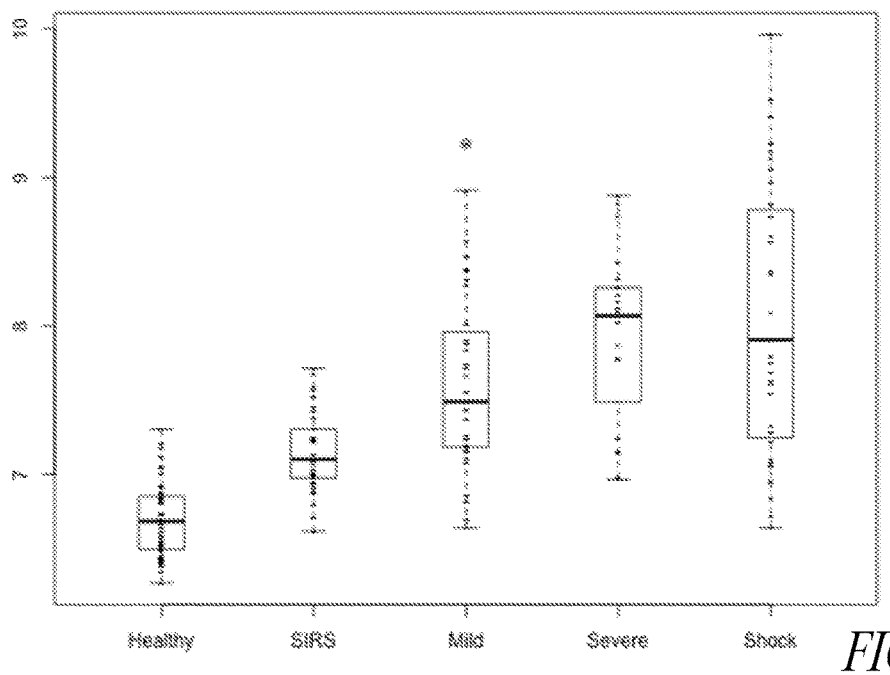
FIG. 60 shows a box and whiskers plot of METTL7B gene expression for healthy subjects and subjects with SIRS, mild sepsis, severe sepsis.
Figure 61:
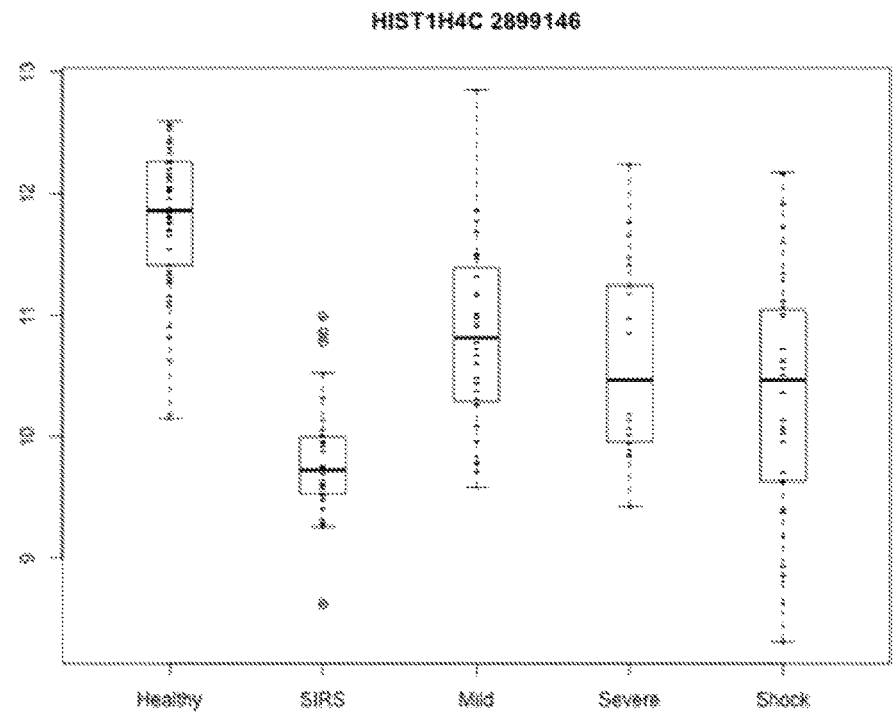
FIG. 61 shows a box and whiskers plot of HIST1H4C gene expression for healthy subjects and subjects with SIRS, mild sepsis, severe sepsis.
Figure 62:
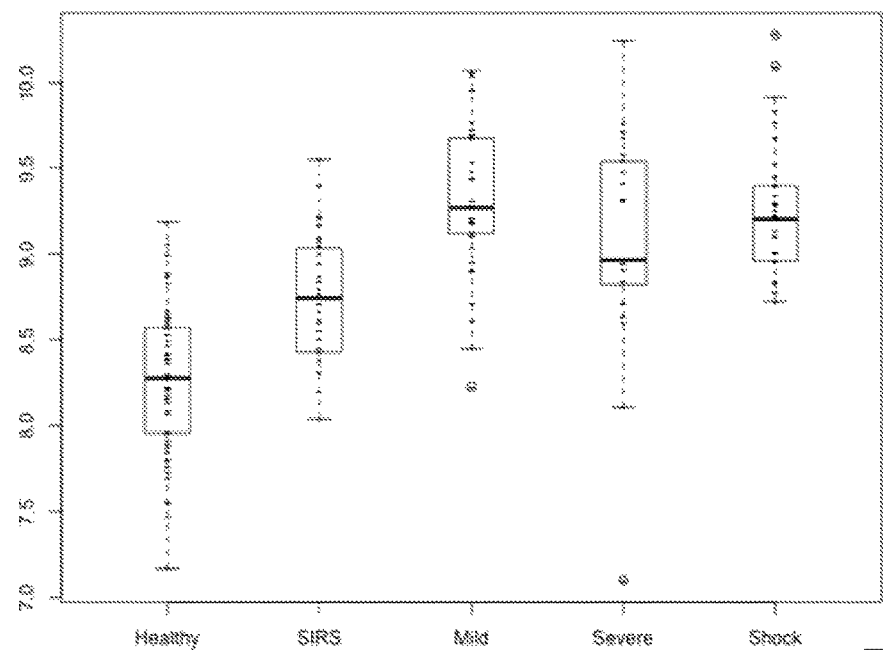
FIG. 62 shows a box and whiskers plot of C9orf72 gene expression for healthy subjects and subjects with SIRS, mild sepsis, severe sepsis.
Figure 63:
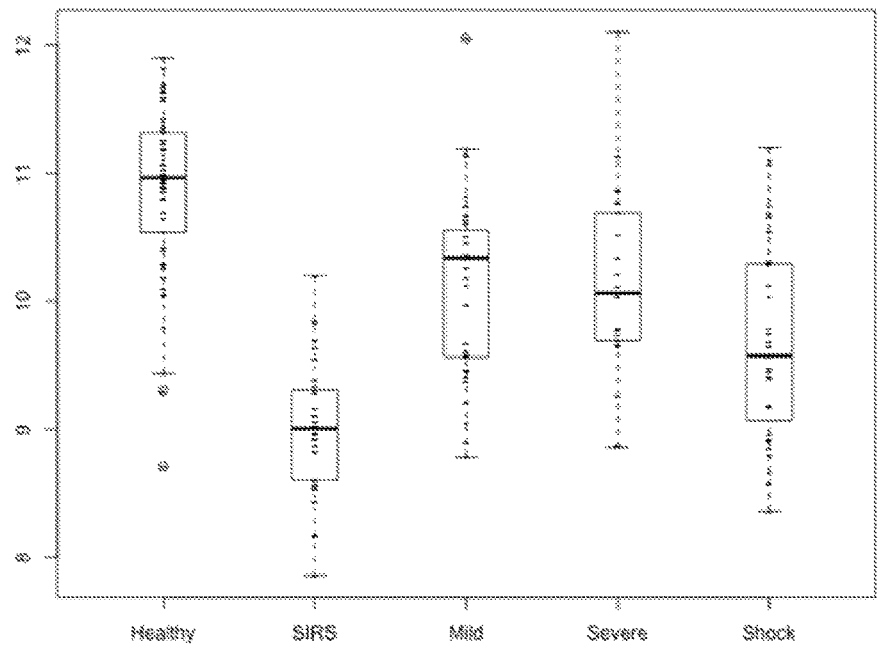
FIG. 63 shows a box and whiskers plot of HIST1H3I gene expression for healthy subjects and subjects with SIRS, mild sepsis, severe sepsis.
Figure 64:
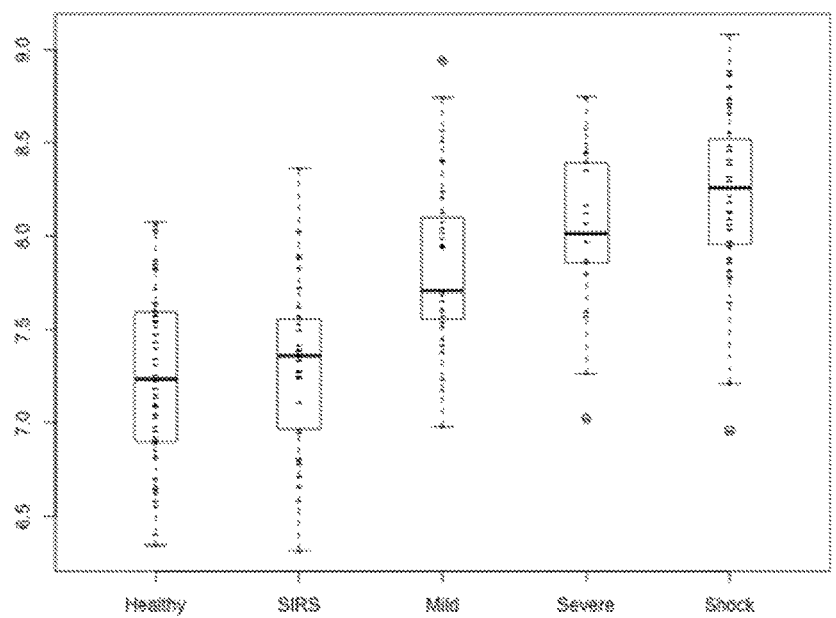
FIG. 64 shows a box and whiskers plot of SLC15A2 gene expression for healthy subjects and subjects with SIRS, mild sepsis, severe sepsis.
Figure 65:
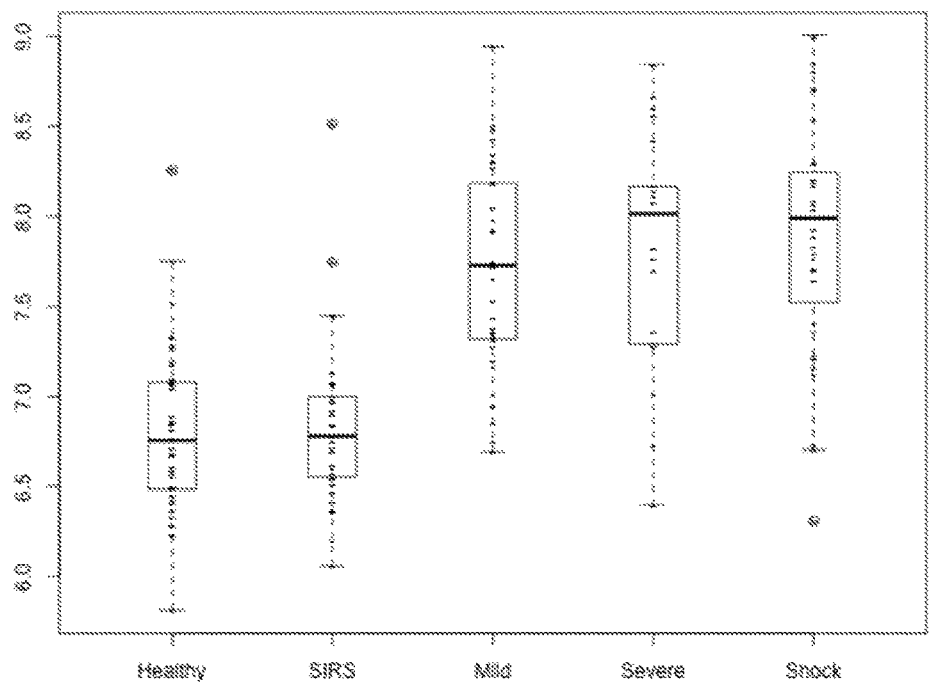
FIG. 65 shows a box and whiskers plot of TLR10 gene expression for healthy subjects and subjects with SIRS, mild sepsis, severe sepsis.
Figure 66:
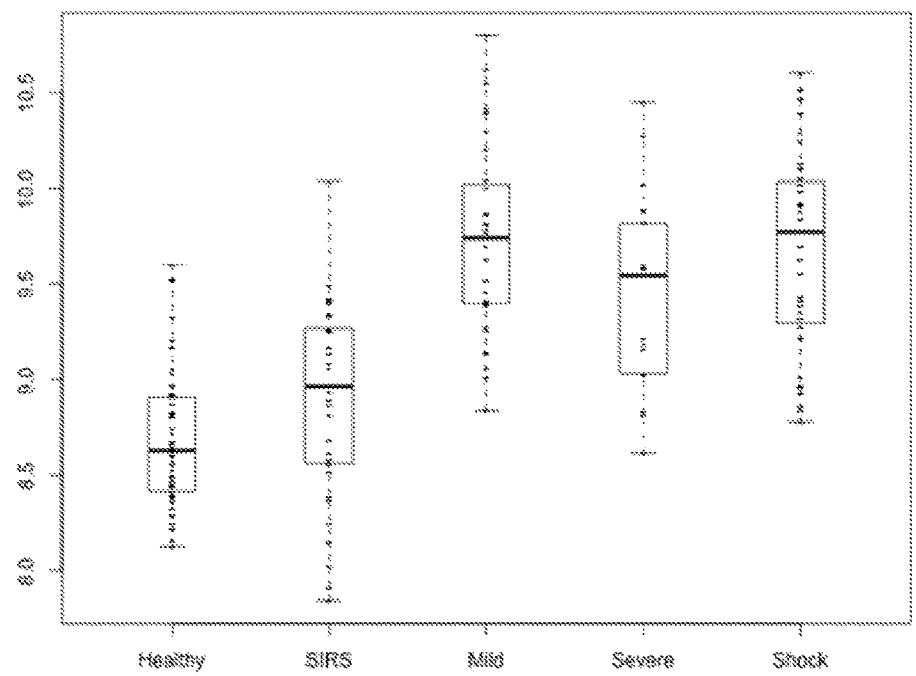
FIG. 66 shows a box and whiskers plot of ADM gene expression for healthy subjects and subjects with SIRS, mild sepsis, severe sepsis.
Figure 67:
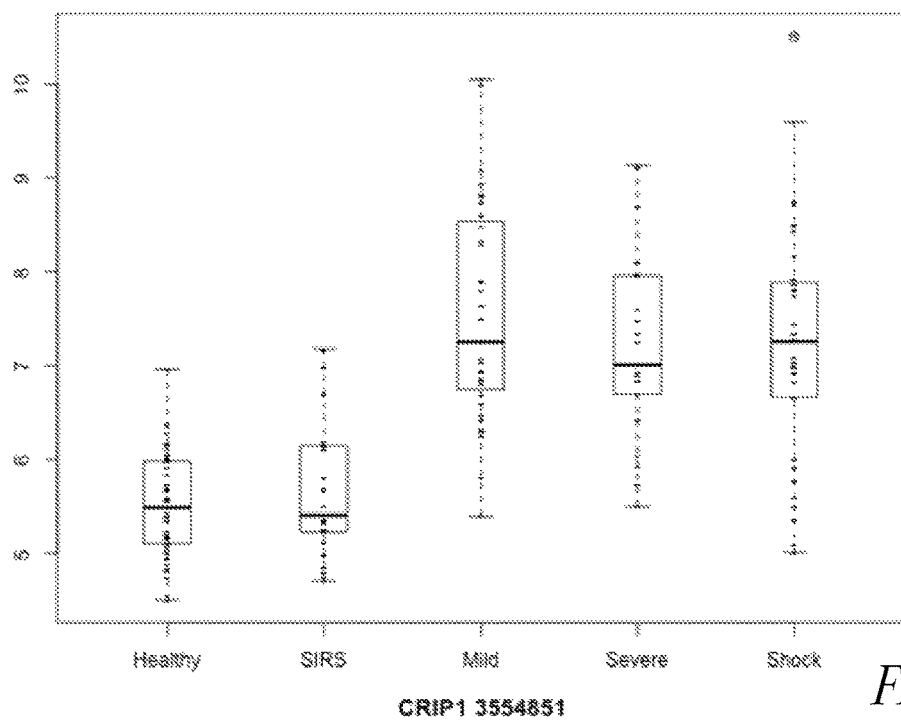
FIG. 67 shows a box and whiskers plot of CD274 gene expression for healthy subjects and subjects with SIRS, mild sepsis, severe sepsis.
Figure 68:
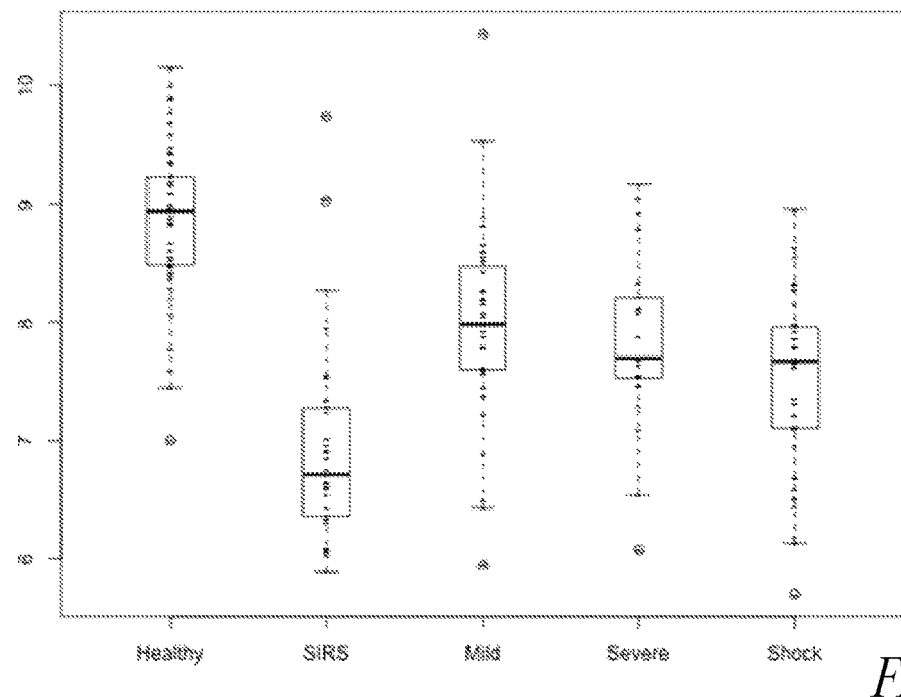
FIG. 68 shows a box and whiskers plot of CRIP1 gene expression for healthy subjects and subjects with SIRS, mild sepsis, severe sepsis.
Figure 69:
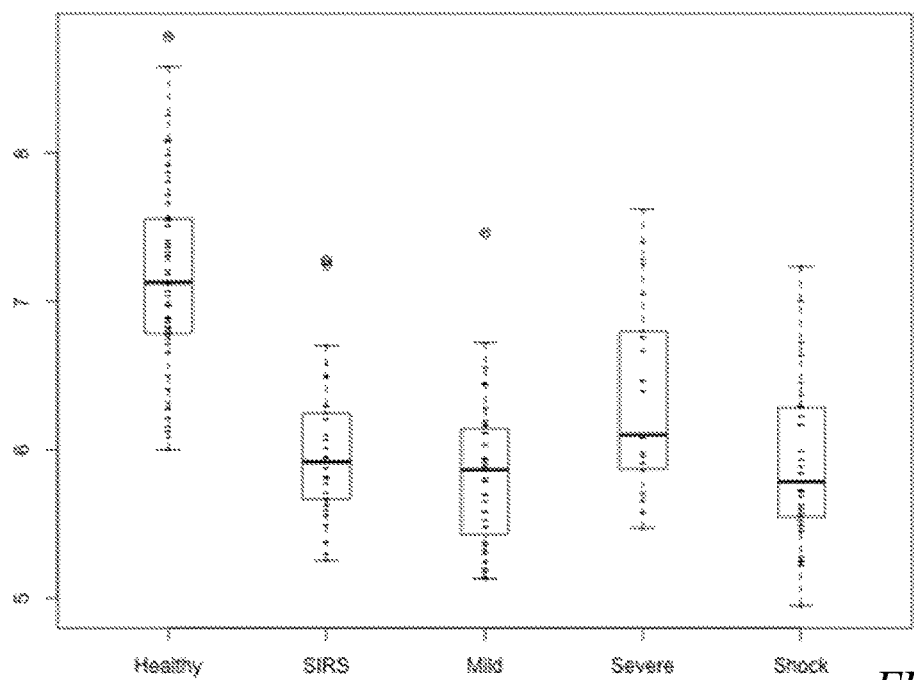
FIG. 69 shows a box and whiskers plot of LRRN3 gene expression for healthy subjects and subjects with SIRS, mild sepsis, severe sepsis.
Figure 70:
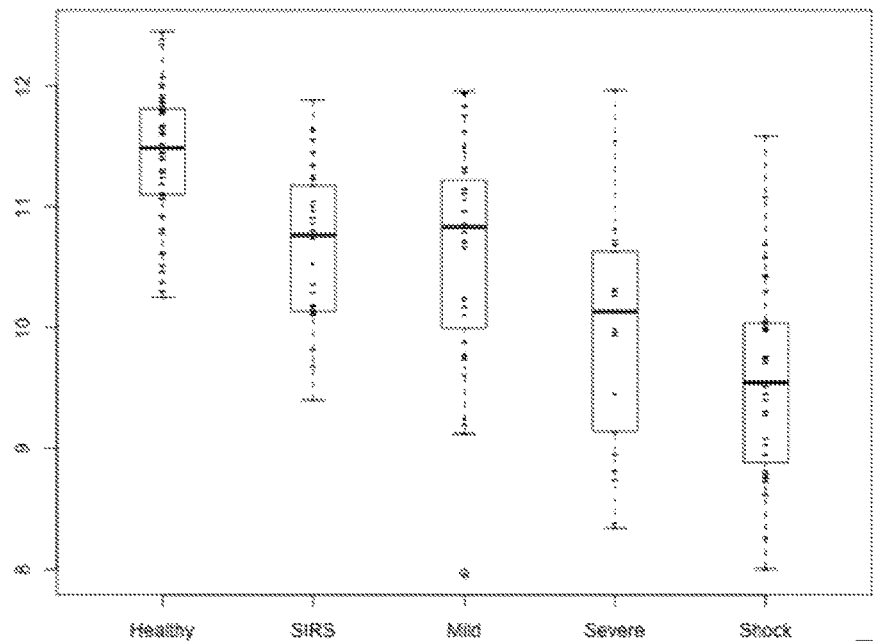
FIG. 70 shows a box and whiskers plot of HLA-DPB1 gene expression for healthy subjects and subjects with SIRS, mild sepsis, severe sepsis.
Figure 71:
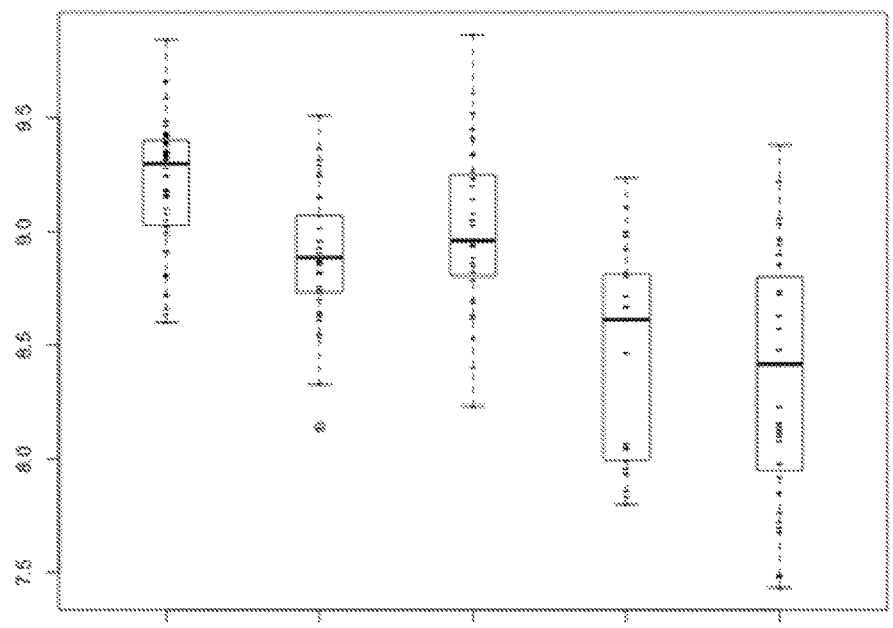
FIG. 71 shows a box and whiskers plot of VAMP2 gene expression for healthy subjects and subjects with SIRS, mild sepsis, severe sepsis.
Figure 72:
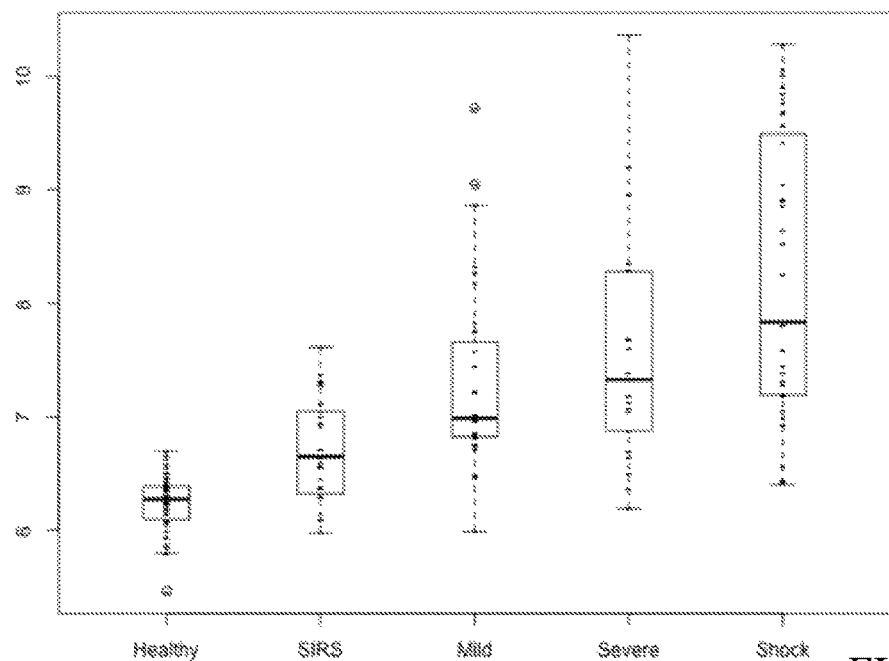
FIG. 72 shows a box and whiskers plot of SMPDL3A gene expression for healthy subjects and subjects with SIRS, mild sepsis, severe sepsis.
Figure 73:
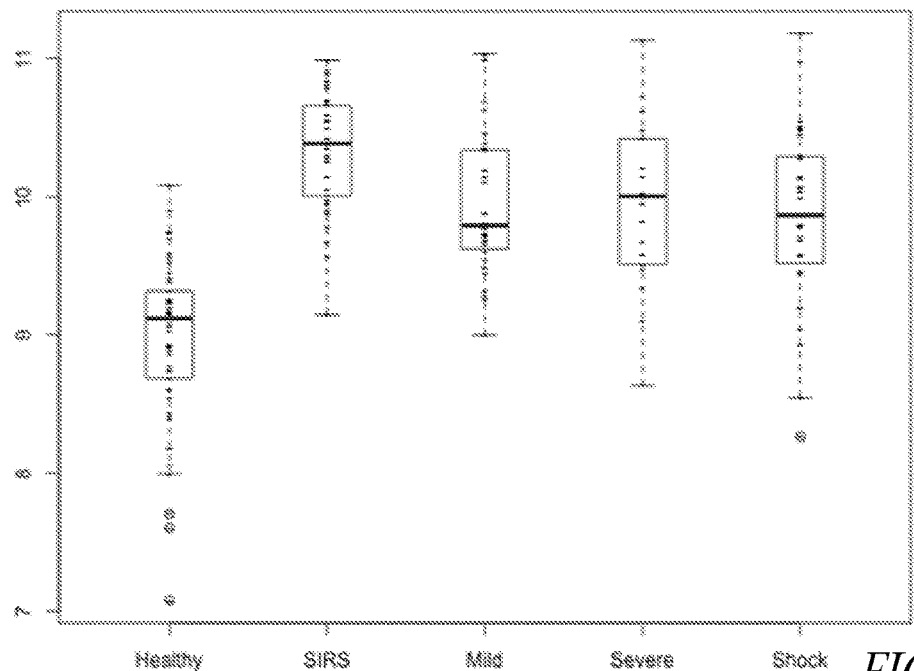
FIG. 73 shows a box and whiskers plot of IFI16 gene expression for healthy subjects and subjects with SIRS, mild sepsis, severe sepsis.
Figure 74:
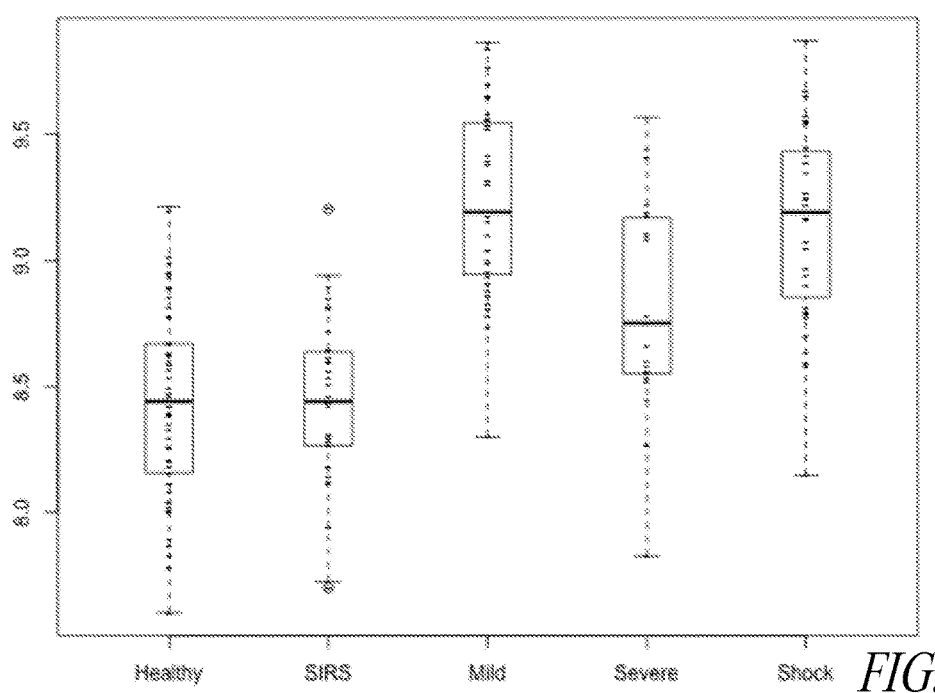
FIG. 74 shows a box and whiskers plot of JKAMP gene expression for healthy subjects and subjects with SIRS, mild sepsis, severe sepsis.
Figure 75:
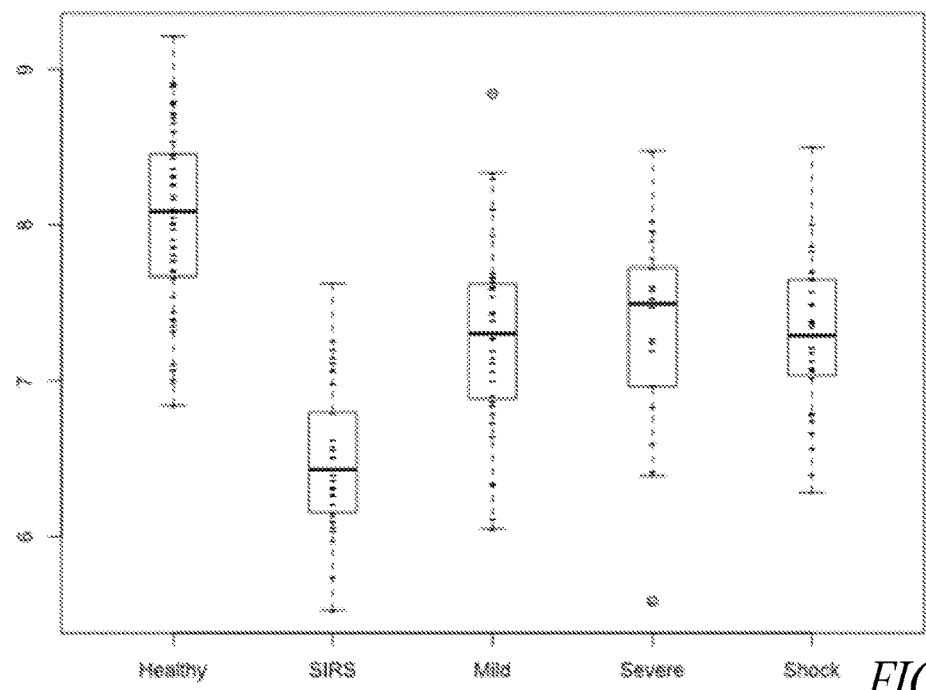
FIG. 75 shows a box and whiskers plot of MRPL41 gene expression for healthy subjects and subjects with SIRS, mild sepsis, severe sepsis.
Figure 76:
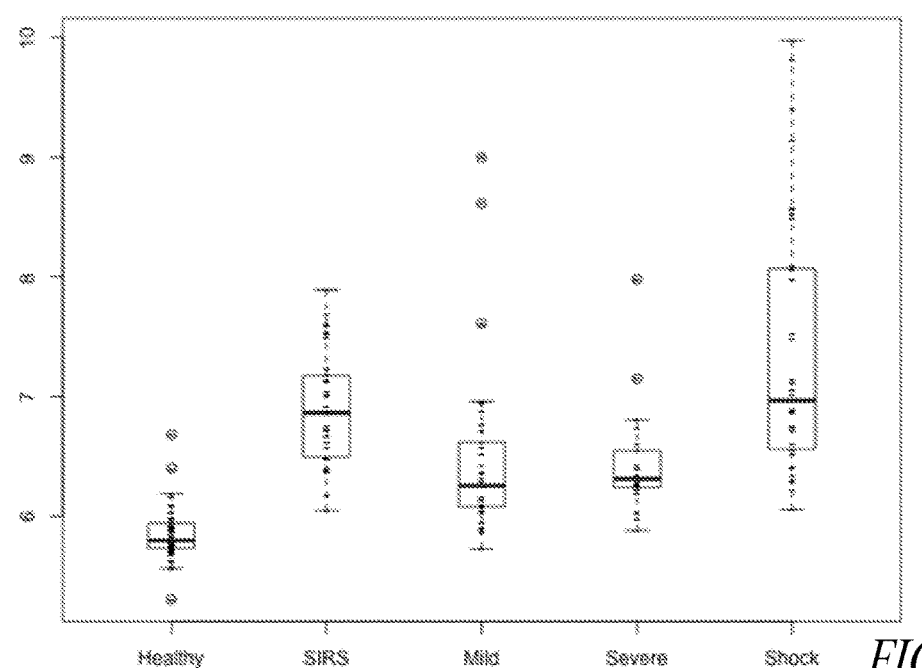
FIG. 76 shows a box and whiskers plot of SLC1A3 gene expression for healthy subjects and subjects with SIRS, mild sepsis, severe sepsis.
Figure 77:
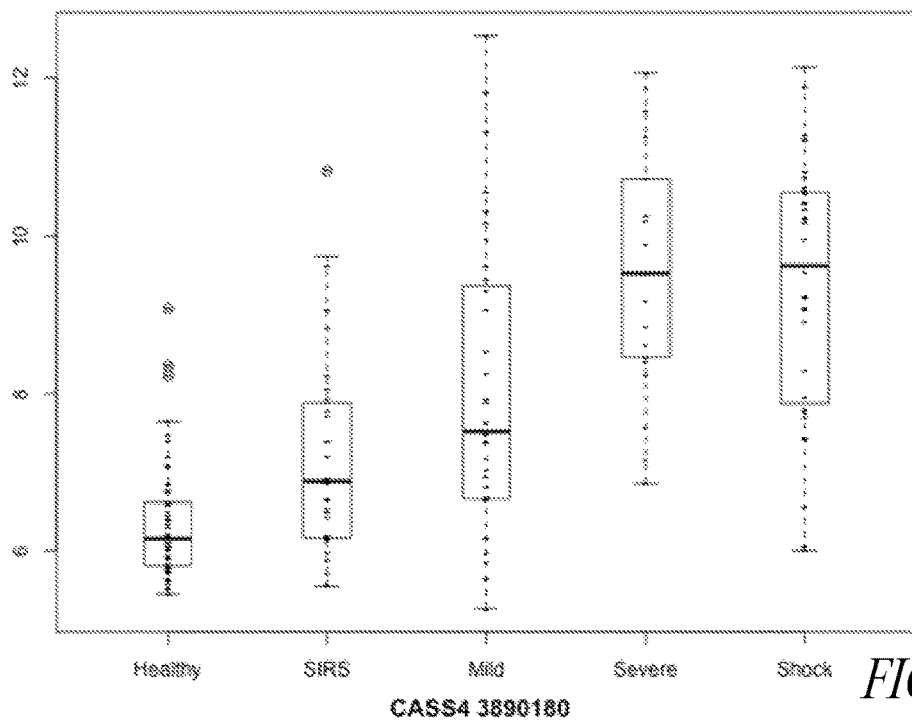
FIG. 77 shows a box and whiskers plot of OLFM4 gene expression for healthy subjects and subjects with SIRS, mild sepsis, severe sepsis.
Figure 78:
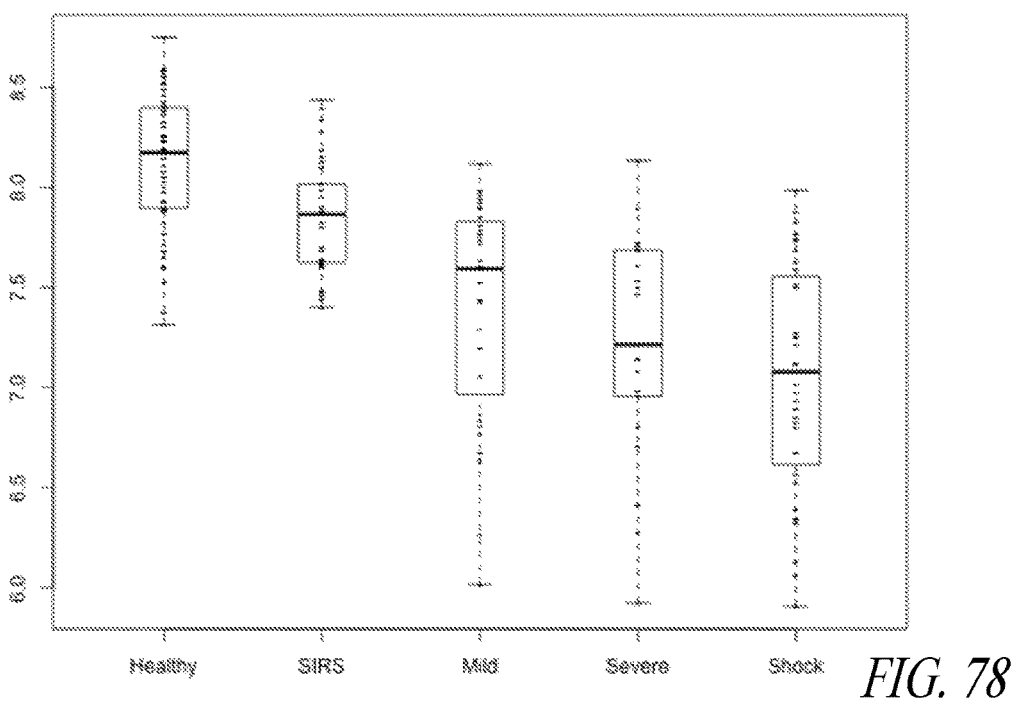
FIG. 78 shows a box and whiskers plot of CASS4 gene expression for healthy subjects and subjects with SIRS, mild sepsis, severe sepsis.
Figure 79:
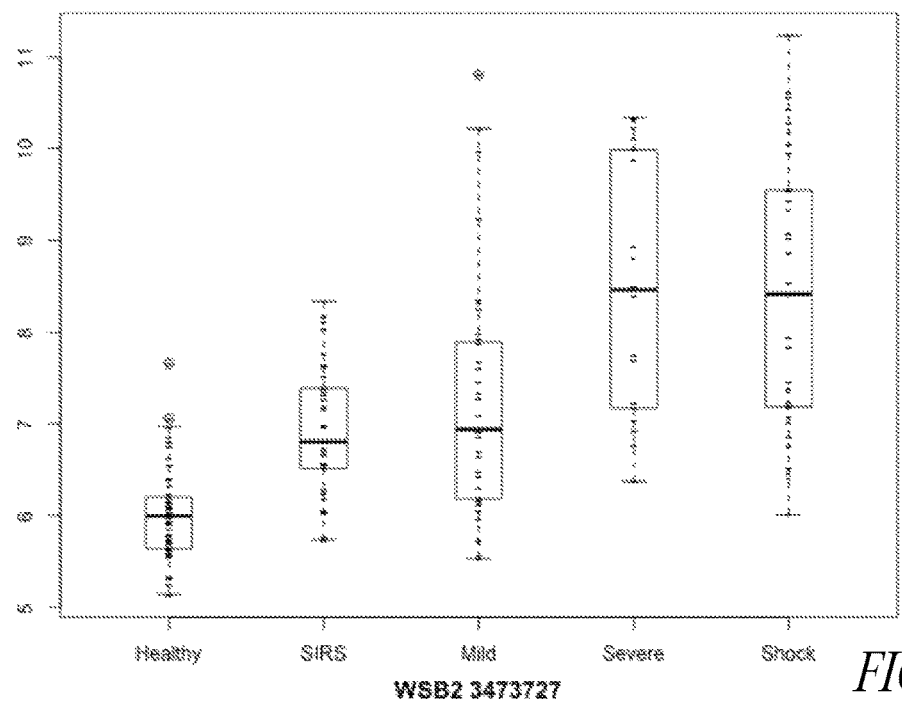
FIG. 79 shows a box and whiskers plot of TCN1 gene expression for healthy subjects and subjects with SIRS, mild sepsis, severe sepsis.
Figure 80:
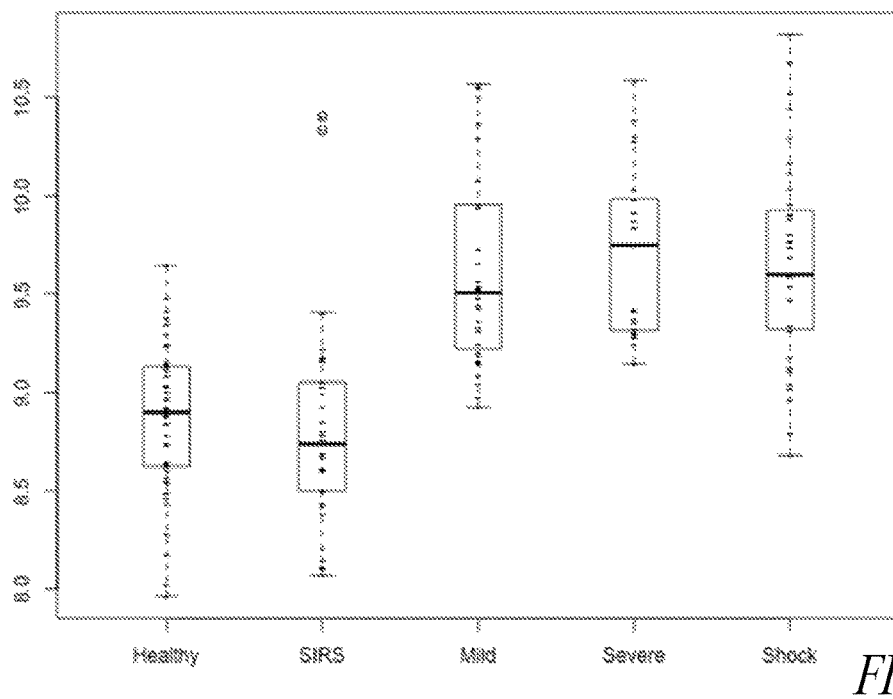
FIG. 80 shows a box and whiskers plot of WSB2 gene expression for healthy subjects and subjects with SIRS, mild sepsis, severe sepsis.
Figure 81:
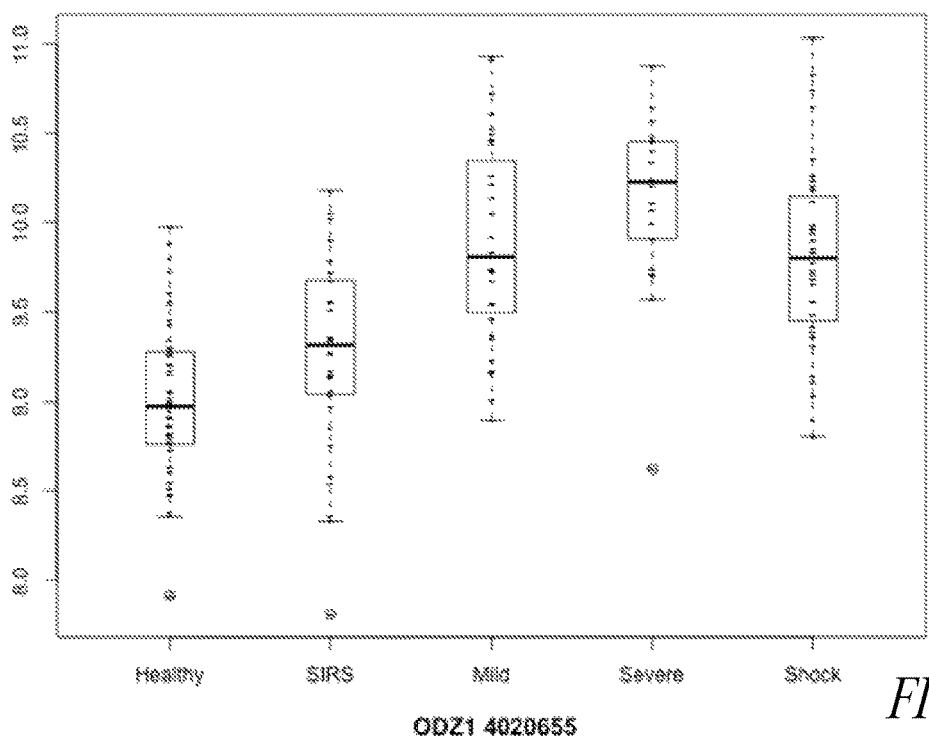
FIG. 81 shows a box and whiskers plot of CLU gene expression for healthy subjects and subjects with SIRS, mild sepsis, severe sepsis.
Figure 82:
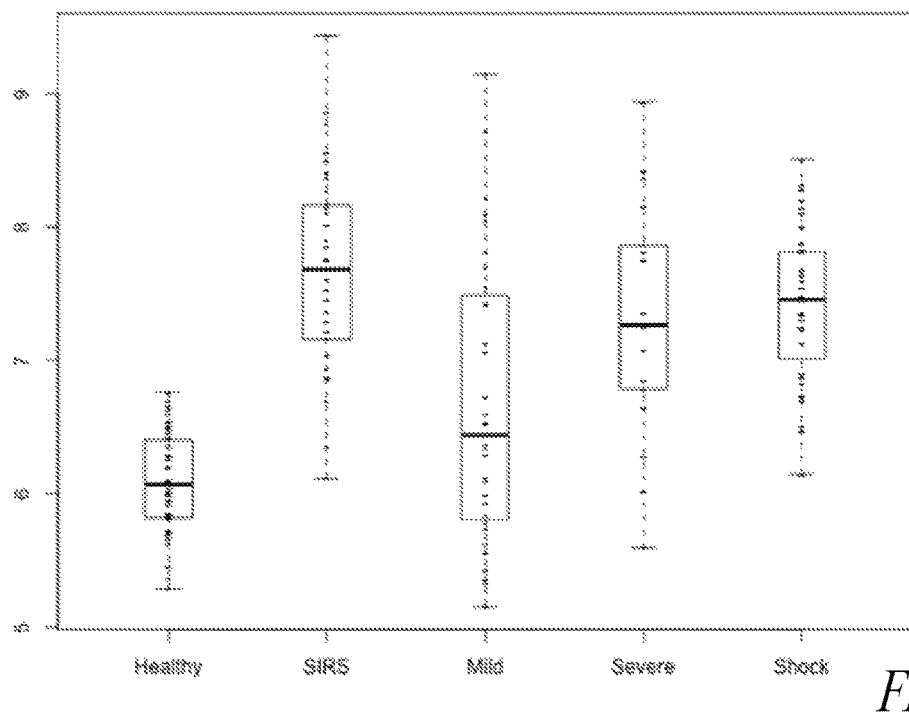
FIG. 82 shows a box and whiskers plot of ODZ1 gene expression for healthy subjects and subjects with SIRS, mild sepsis, severe sepsis.
Figure 83:
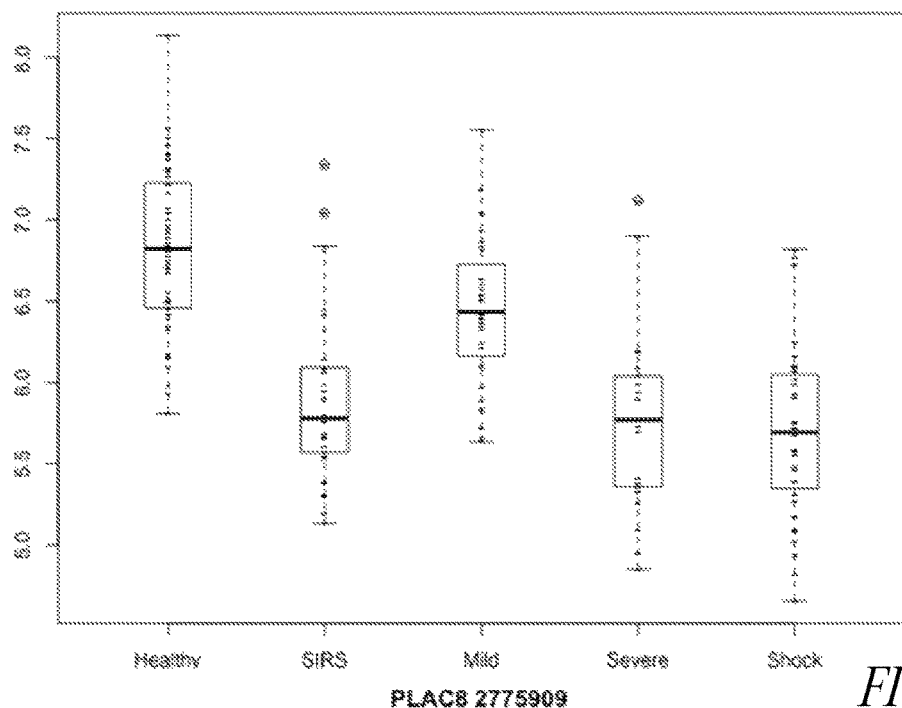
FIG. 83 shows a box and whiskers plot of KPNA5 gene expression for healthy subjects and subjects with SIRS, mild sepsis, severe sepsis.
Figure 84:
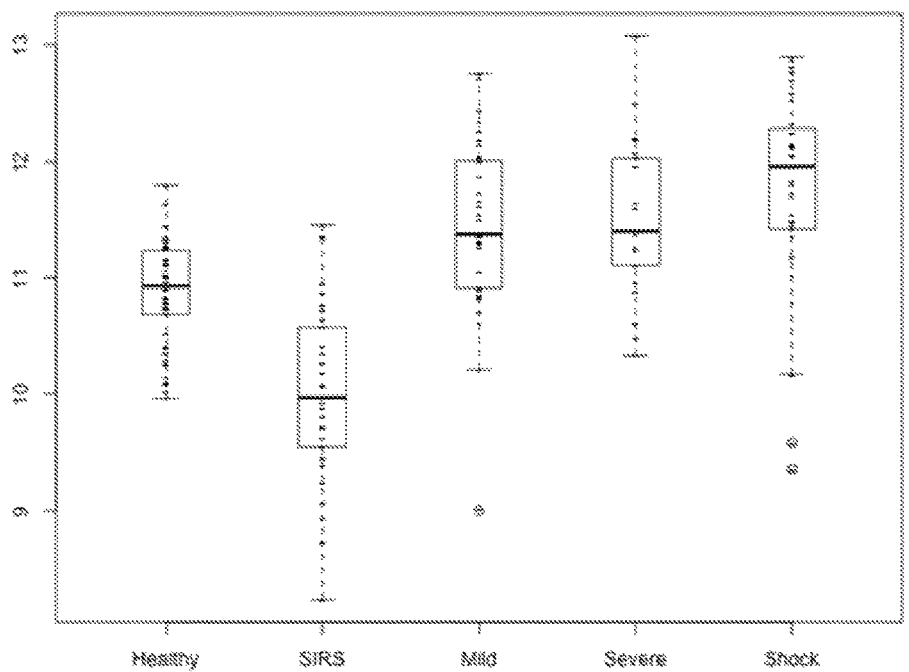
FIG. 84 shows a box and whiskers plot of PLAC8 gene expression for healthy subjects and subjects with SIRS, mild sepsis, severe sepsis.
Figure 85:
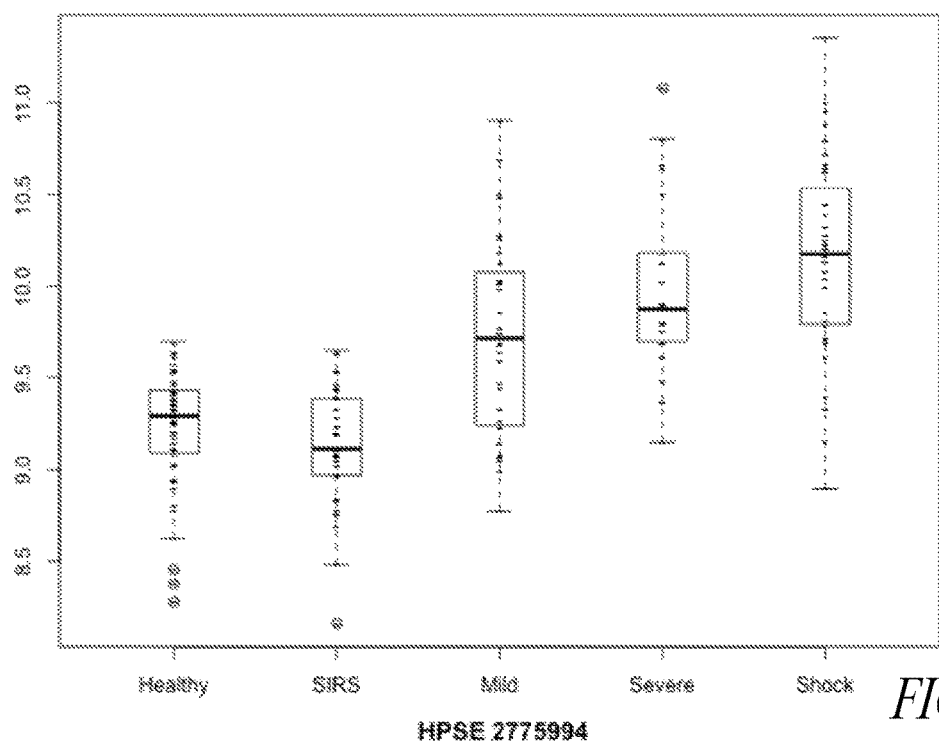
FIG. 85 shows a box and whiskers plot of CD63 gene expression for healthy subjects and subjects with SIRS, mild sepsis, severe sepsis.
Figure 86:
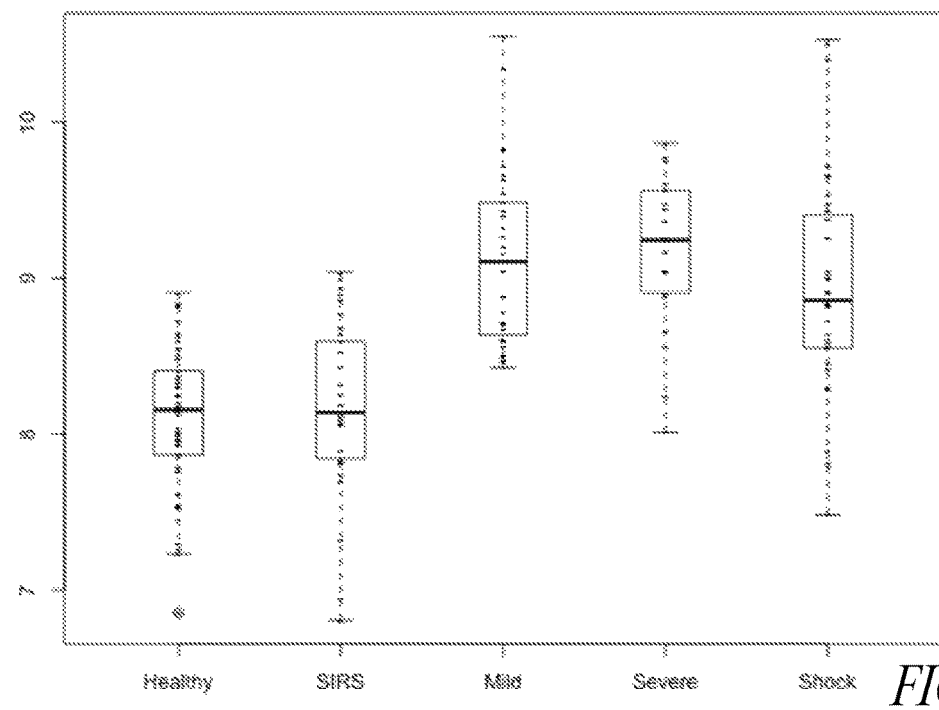
FIG. 86 shows a box and whiskers plot of HPSE gene expression for healthy subjects and subjects with SIRS, mild sepsis, severe sepsis.
Figure 87:
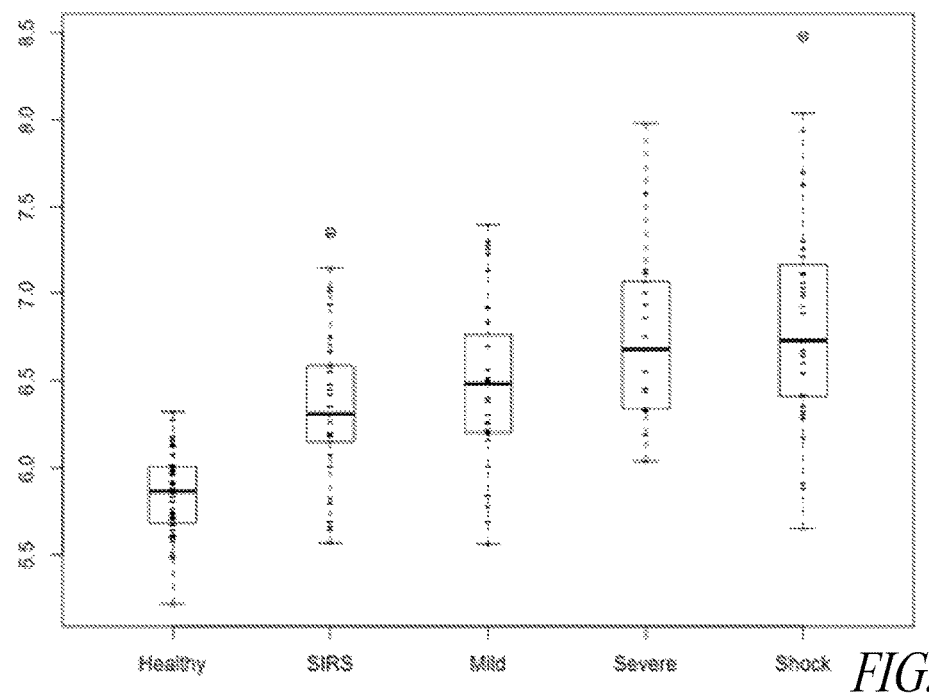
FIG. 87 shows a box and whiskers plot of C1orf161 gene expression for healthy subjects and subjects with SIRS, mild sepsis, severe sepsis.
Figure 88:
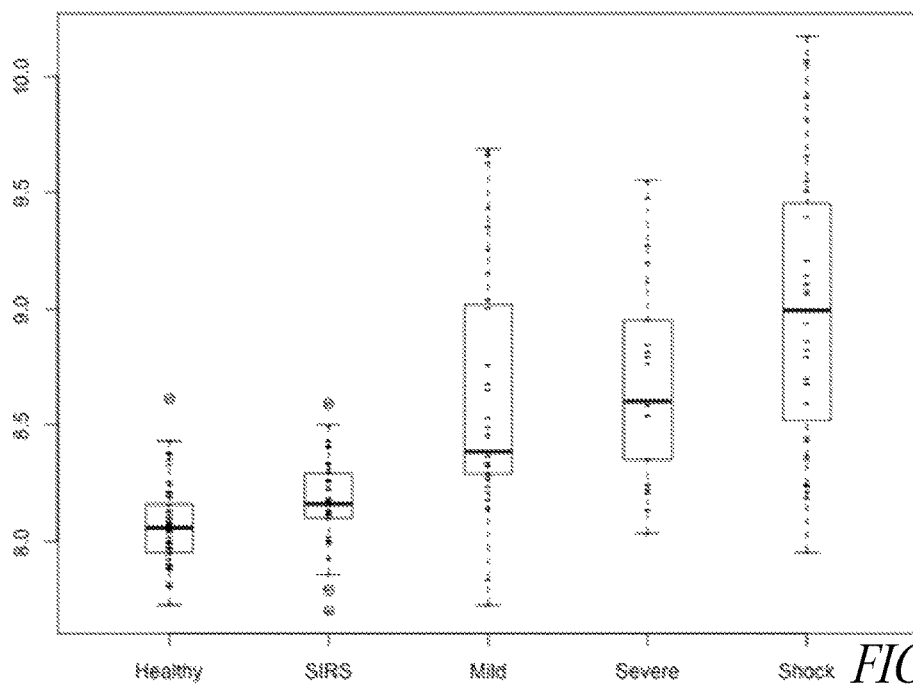
FIG. 88 shows a box and whiskers plot of DDAH2 gene expression for healthy subjects and subjects with SIRS, mild sepsis, severe sepsis.
Figure 89:
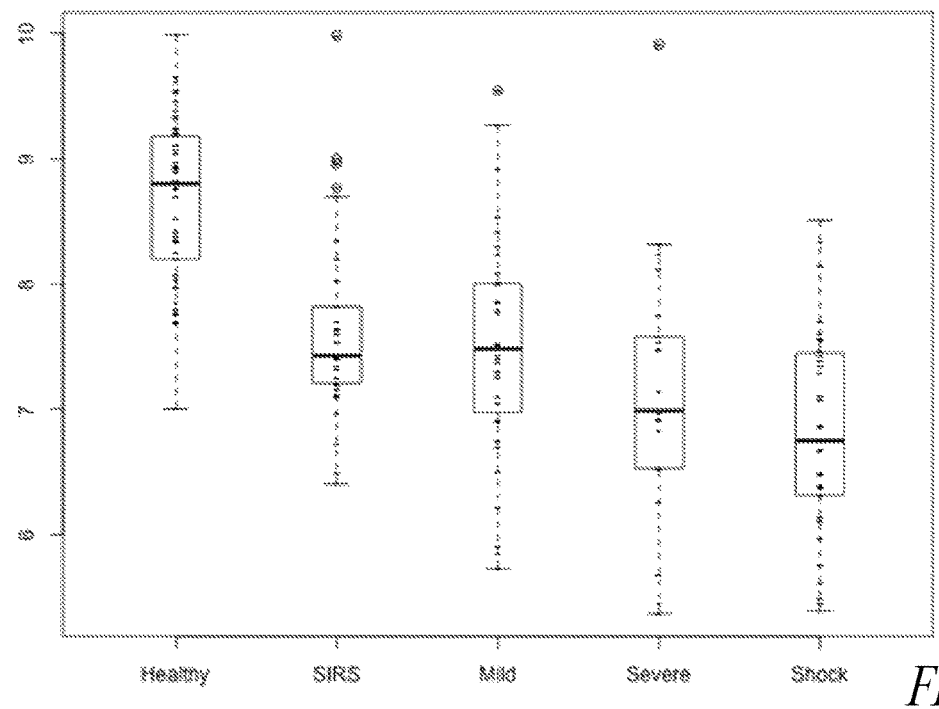
FIG. 89 shows a box and whiskers plot of KLRK1// KLRC4 gene expression for healthy subjects and subjects with SIRS, mild sepsis, severe sepsis.
Figure 90:
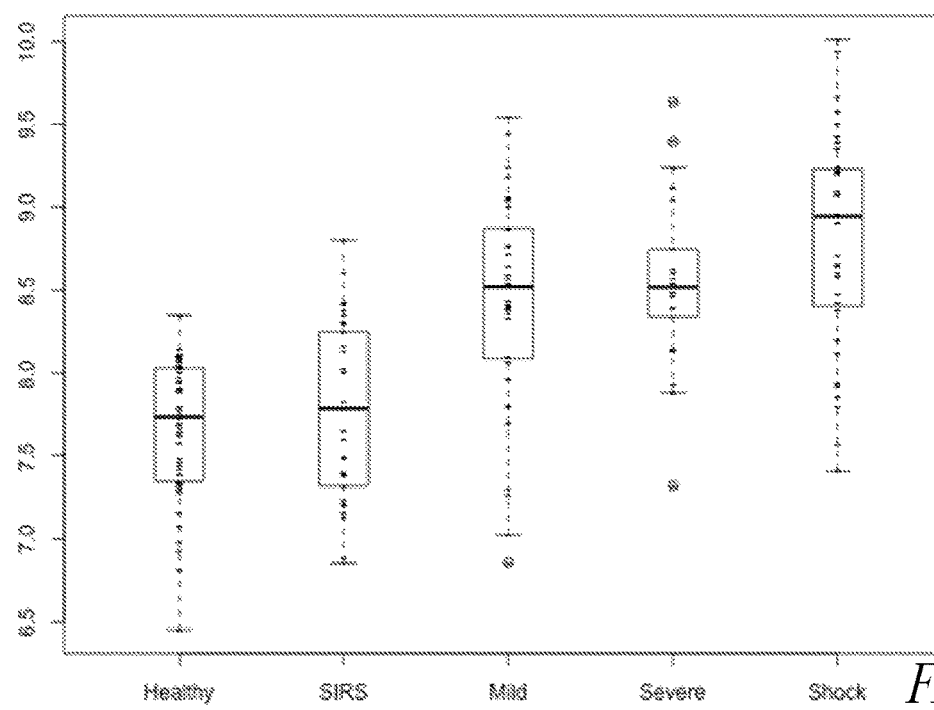
FIG. 90 shows a box and whiskers plot of ATP13A3 gene expression for healthy subjects and subjects with SIRS, mild sepsis, severe sepsis.
Figure 91:
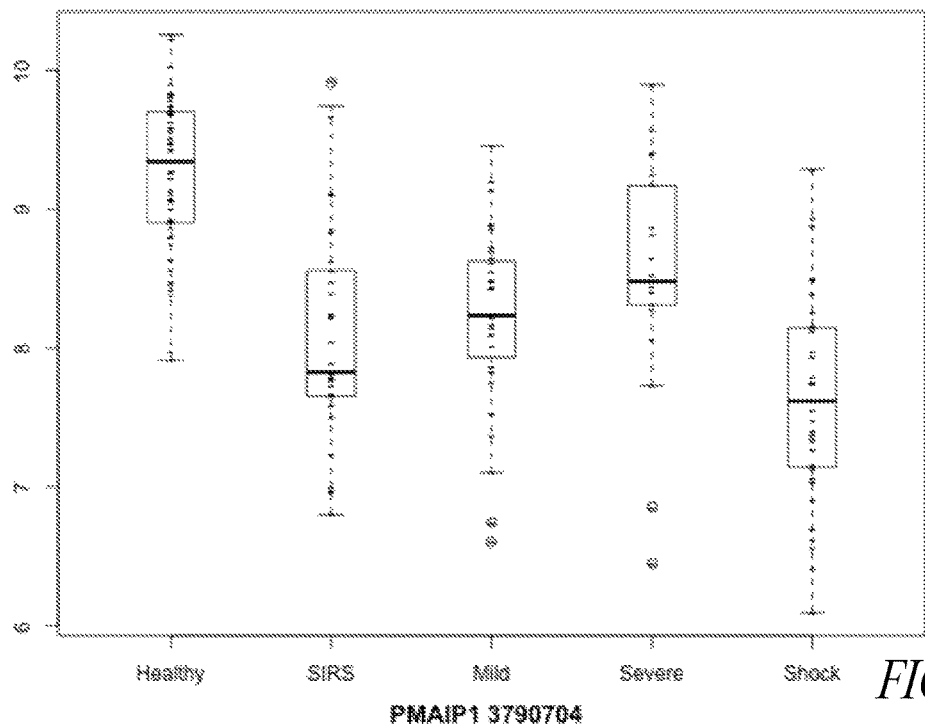
FIG. 91 shows a box and whiskers plot of ITK gene expression for healthy subjects and subjects with SIRS, mild sepsis, severe sepsis.
Figure 92:
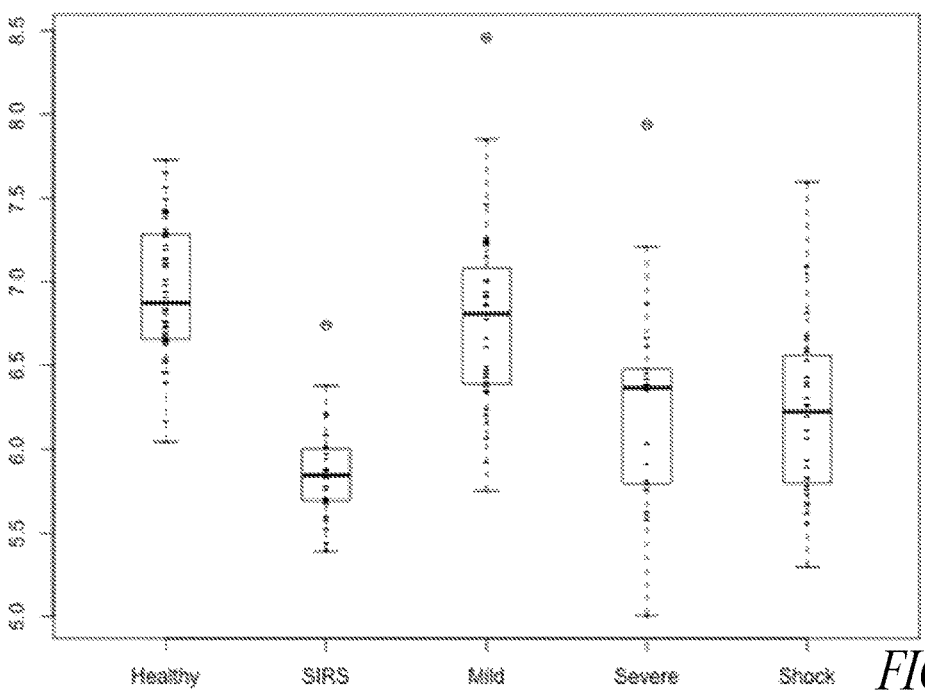
FIG. 92 shows a box and whiskers plot of PMAIP1 gene expression for healthy subjects and subjects with SIRS, mild sepsis, severe sepsis.
Figure 93:
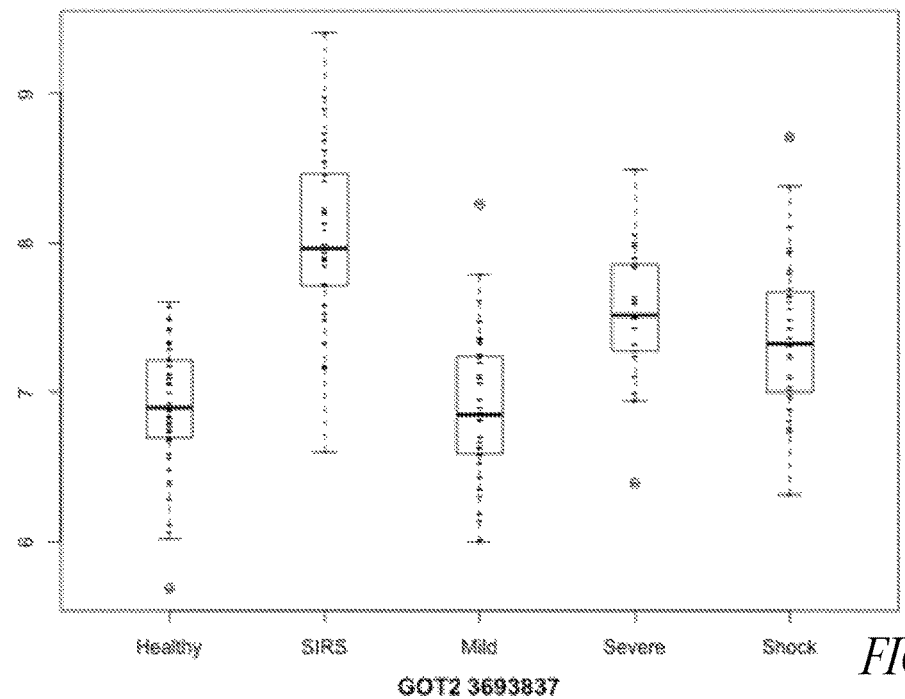
FIG. 93 shows a box and whiskers plot of LOC284757 gene expression for healthy subjects and subjects with SIRS, mild sepsis, severe sepsis.
Figure 94:
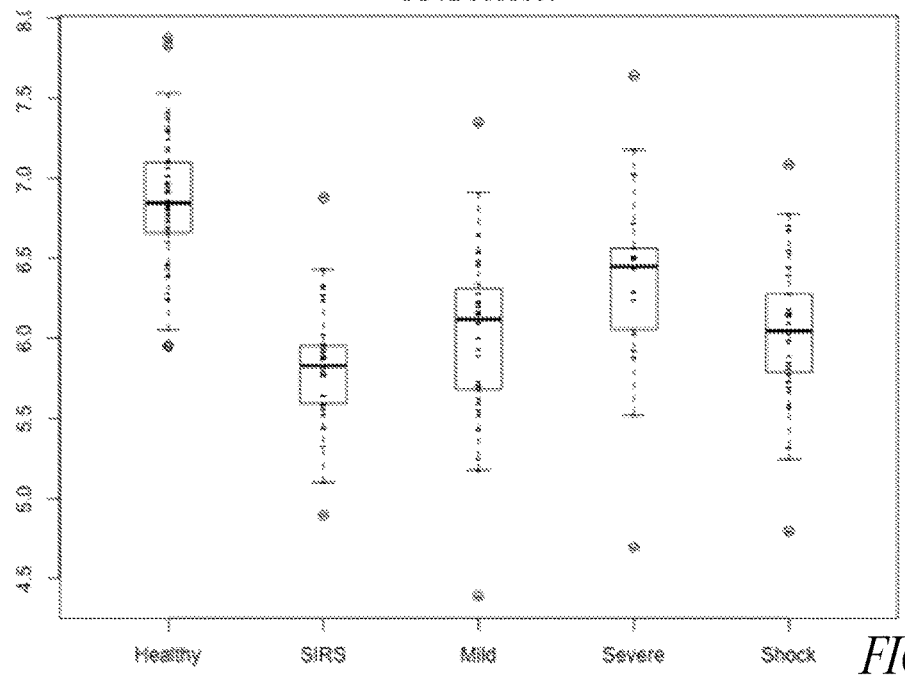
FIG. 94 shows a box and whiskers plot of GOT2 gene expression for healthy subjects and subjects with SIRS, mild sepsis, severe sepsis.
Figure 95:
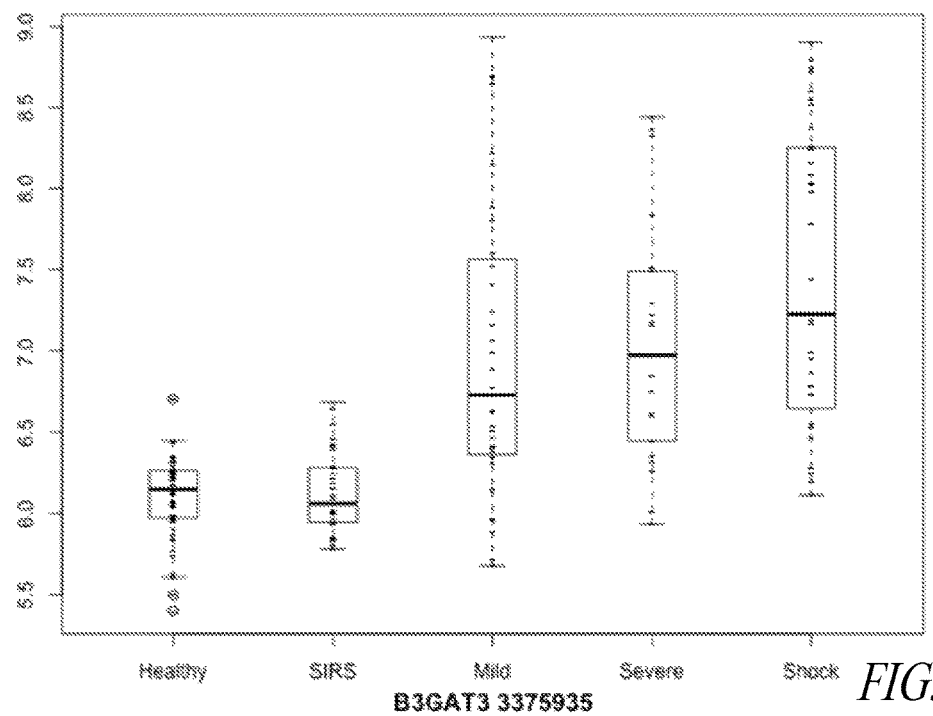
FIG. 95 shows a box and whiskers plot of PDGFC gene expression for healthy subjects and subjects with SIRS, mild sepsis, severe sepsis.
Figure 96:
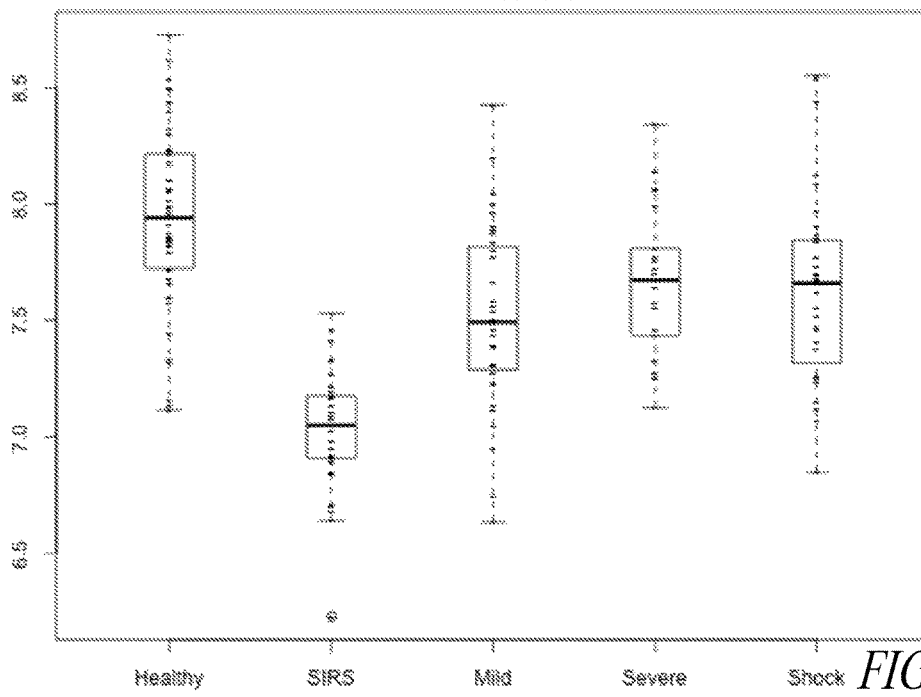
FIG. 96 shows a box and whiskers plot of B3GAT3 gene expression for healthy subjects and subjects with SIRS, mild sepsis, severe sepsis.
Figure 97:
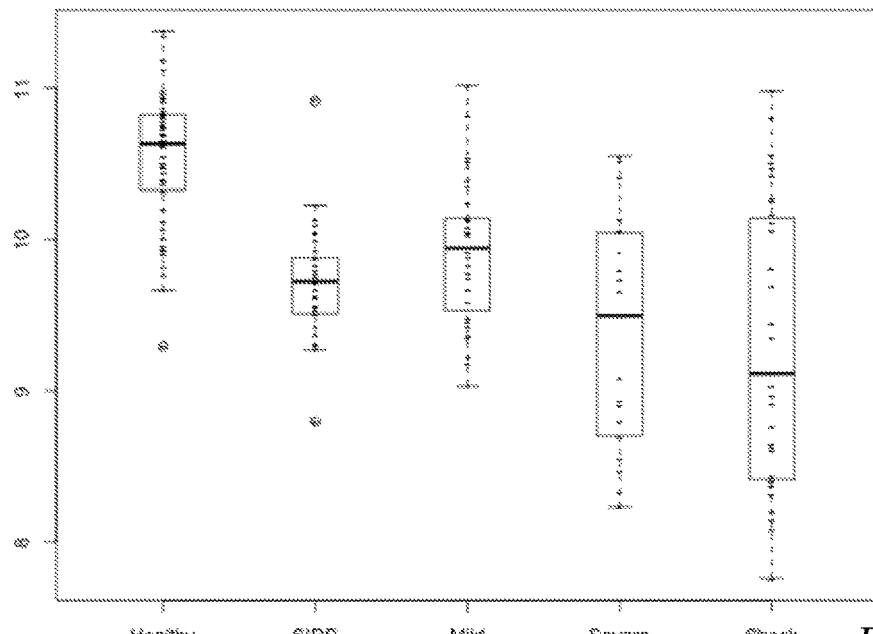
FIG. 97 shows a box and whiskers plot of HIST1H4E gene expression for healthy subjects and subjects with SIRS, mild sepsis, severe sepsis.
Figure 98:
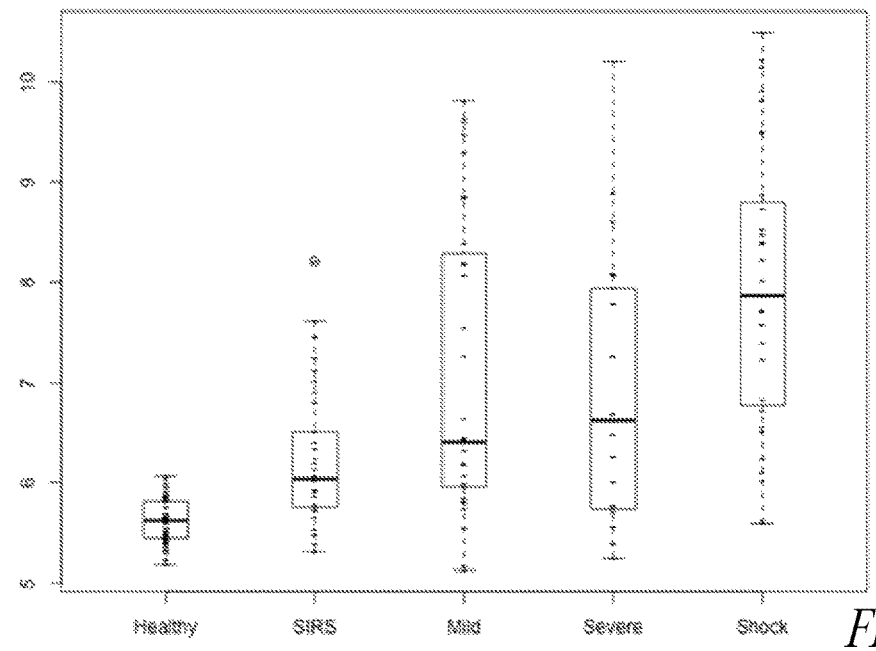
FIG. 98 shows a box and whiskers plot of HPGD gene expression for healthy subjects and subjects with SIRS, mild sepsis, severe sepsis.
Figure 99:
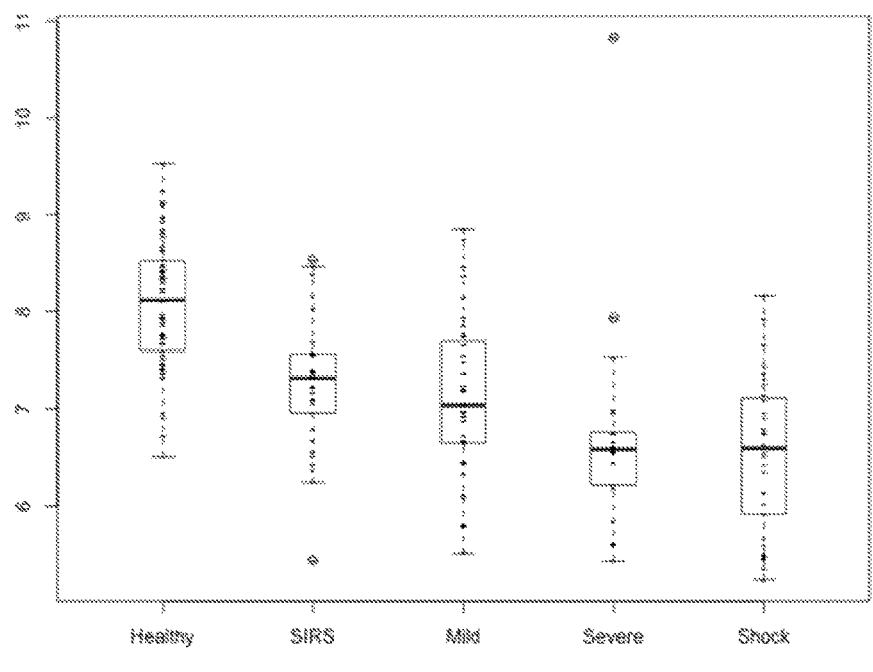
FIG. 99 shows a box and whiskers plot of FGFBP2 gene expression for healthy subjects and subjects with SIRS, mild sepsis, severe sepsis.
Figure 100:
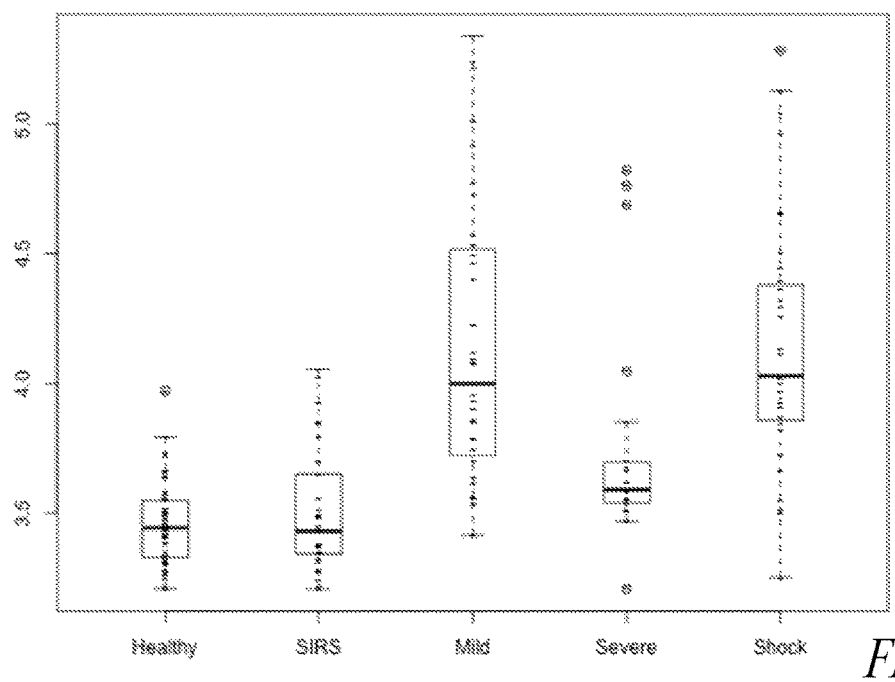
FIG. 100 shows a box and whiskers plot of LRRC70// IPO11 gene expression for healthy subjects and subjects with SIRS, mild sepsis, severe sepsis.
Figure 101:
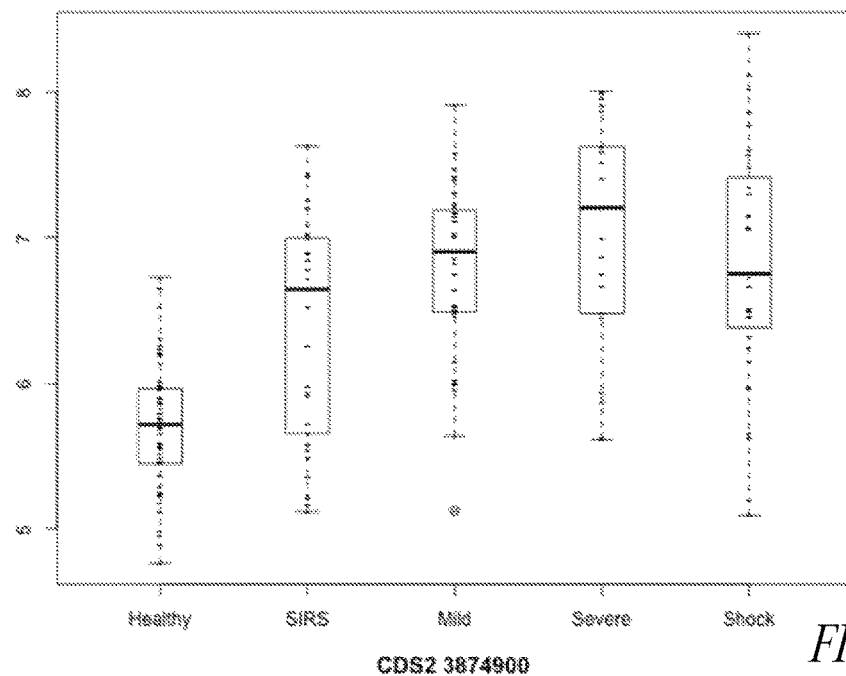
FIG. 101 shows a box and whiskers plot of TMEM144/ LOC285505 gene expression for healthy subjects and subjects with SIRS, mild sepsis, severe sepsis.
Figure 102:
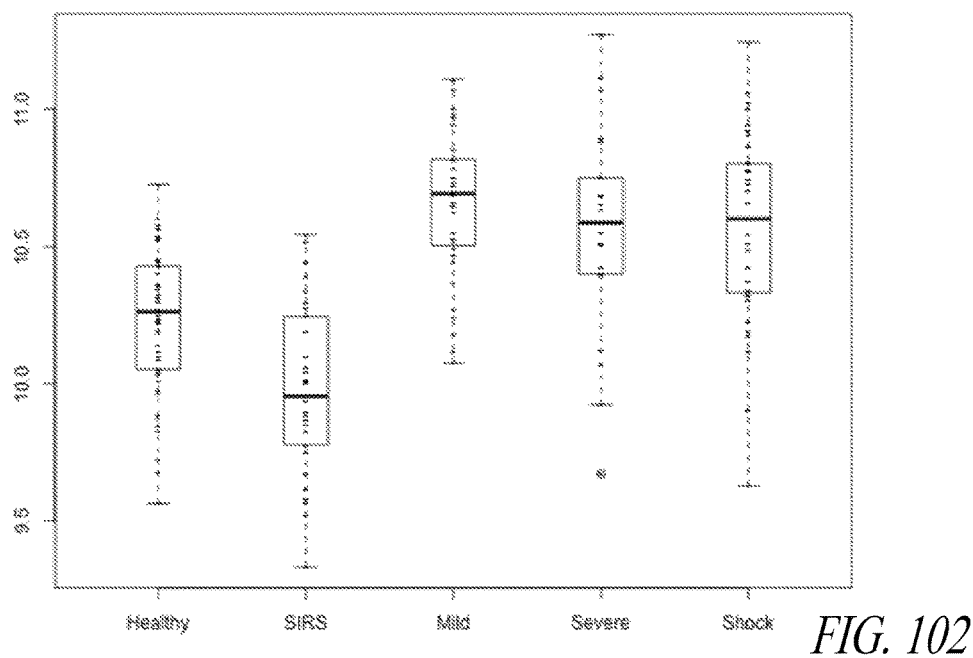
FIG. 102 shows a box and whiskers plot of CDS2 gene expression for healthy subjects and subjects with SIRS, mild sepsis, severe sepsis.
Figure 103:
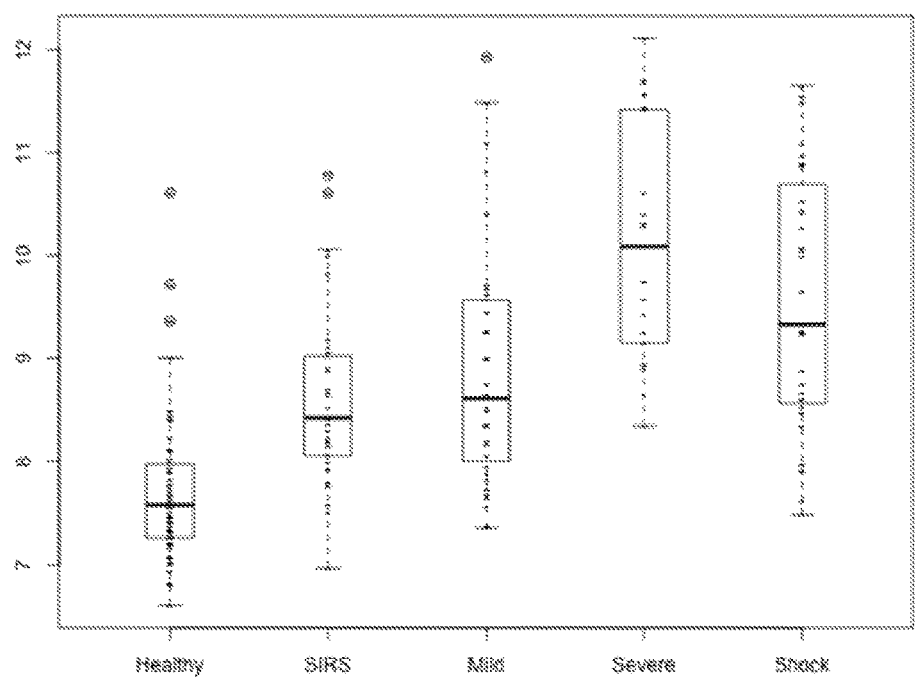
FIG. 103 shows a box and whiskers plot of BPI gene expression for healthy subjects and subjects with SIRS, mild sepsis, severe sepsis.
Figure 104:

FIG. 104 shows a box and whiskers plot of ECHDC3 gene expression for healthy subjects and subjects with SIRS, mild sepsis, severe sepsis.
Figure 105:
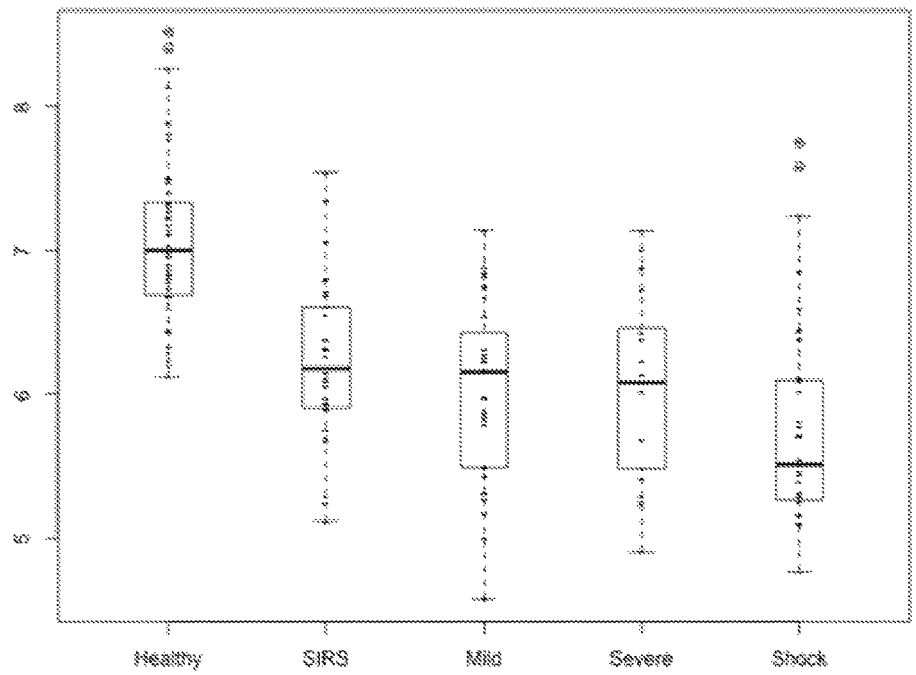
FIG. 105 shows a box and whiskers plot of CCR3 gene expression for healthy subjects and subjects with SIRS, mild sepsis, severe sepsis.
Figure 106:
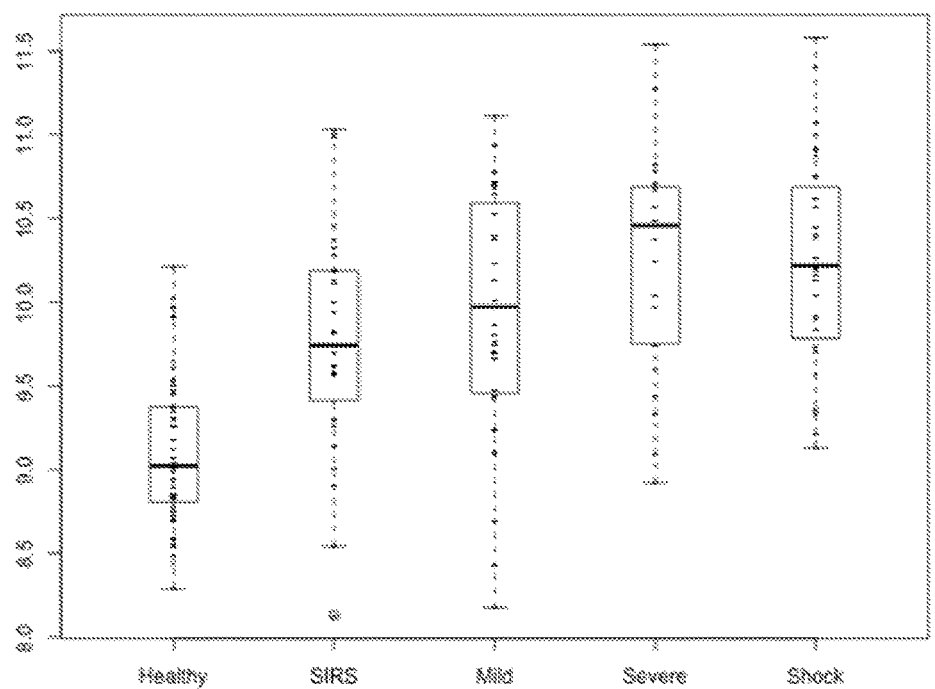
FIG. 106 shows a box and whiskers plot of HSPC159 gene expression for healthy subjects and subjects with SIRS, mild sepsis, severe sepsis.
Figure 107:
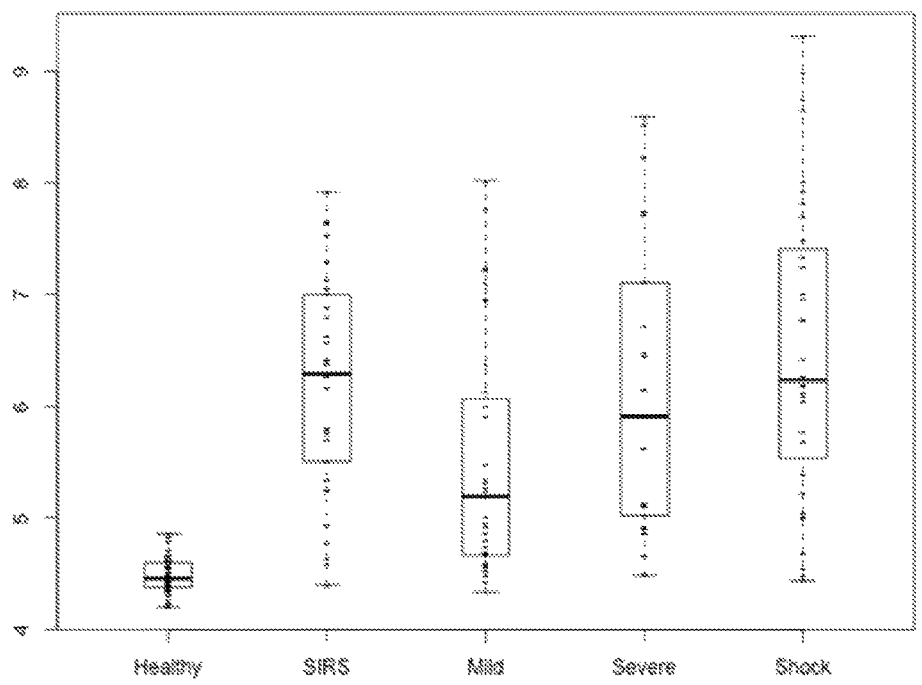
FIG. 107 shows a box and whiskers plot of OLAH gene expression for healthy subjects and subjects with SIRS, mild sepsis, severe sepsis.
Figure 108:
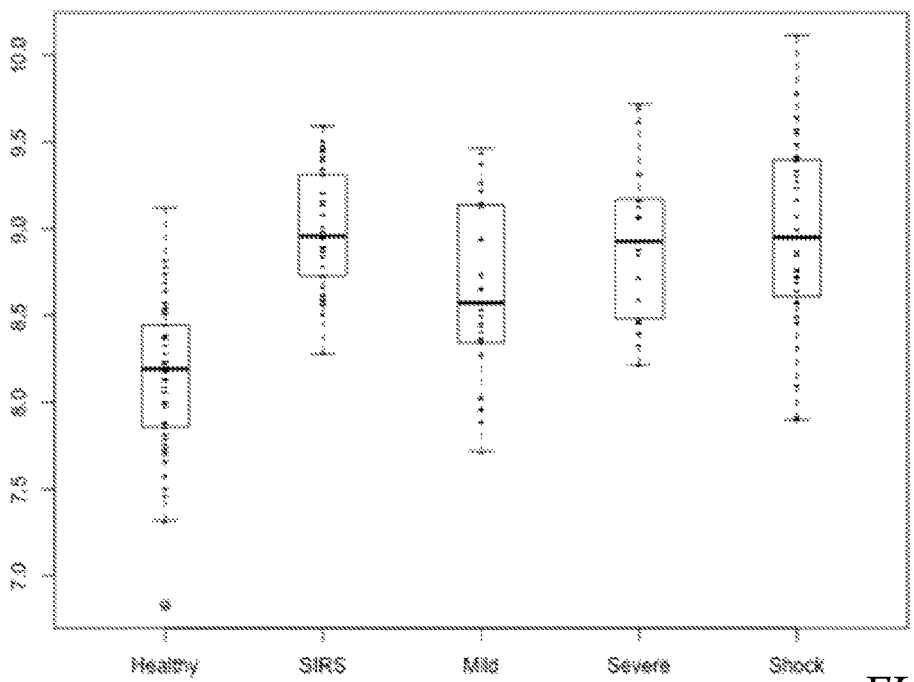
FIG. 108 shows a box and whiskers plot of PPP2R5A// SNORA16B gene expression for healthy subjects and subjects with SIRS, mild sepsis, severe sepsis.
Figure 109:
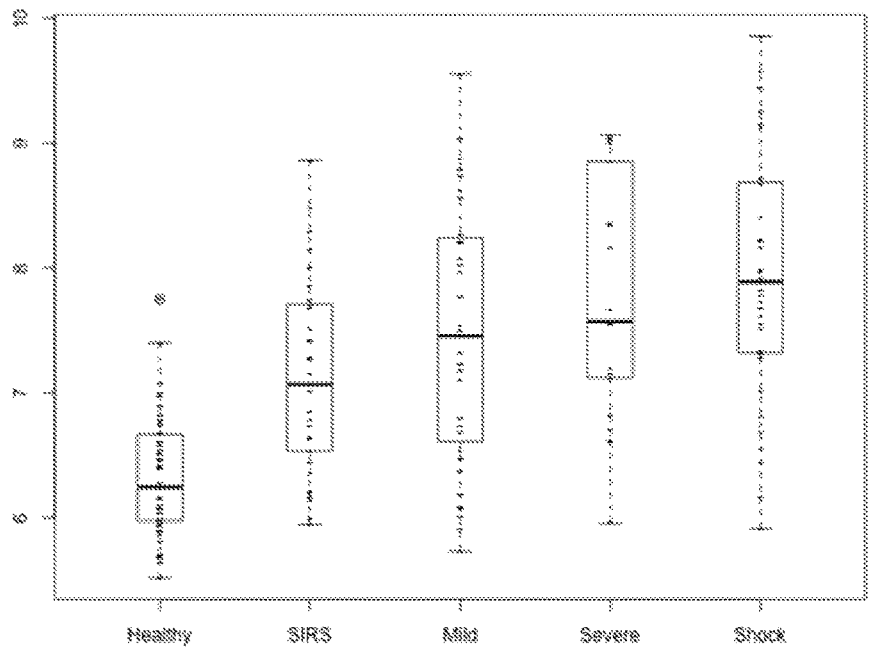
FIG. 109 shows a box and whiskers plot of TMTC1 gene expression for healthy subjects and subjects with SIRS, mild sepsis, severe sepsis.
Figure 110:
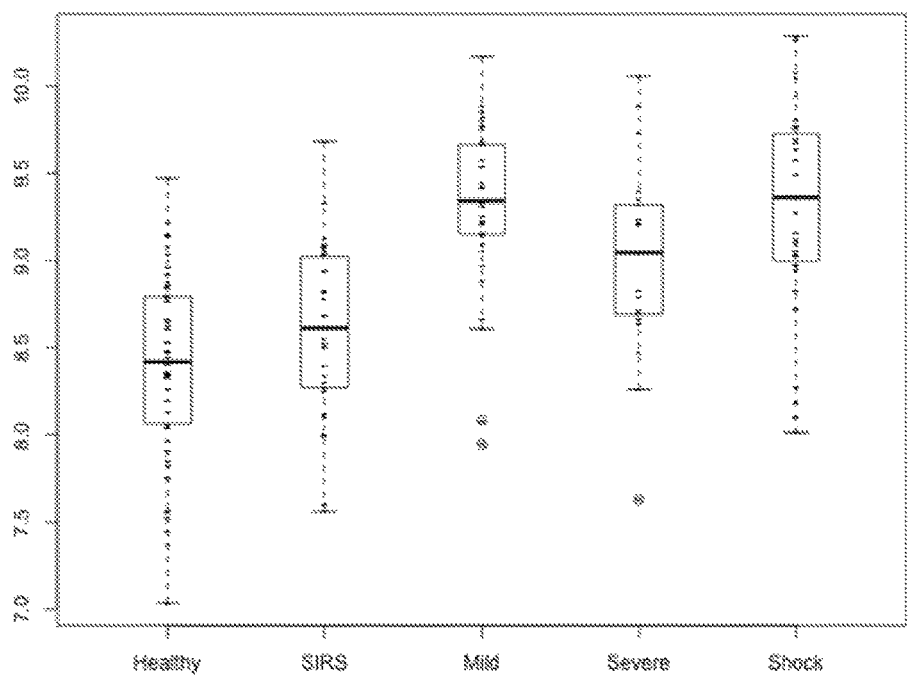
FIG. 110 shows a box and whiskers plot of EAF2// HCG11//LOC647979 gene expression for healthy subjects and subjects with SIRS, mild sepsis, severe sepsis.
Figure 111:
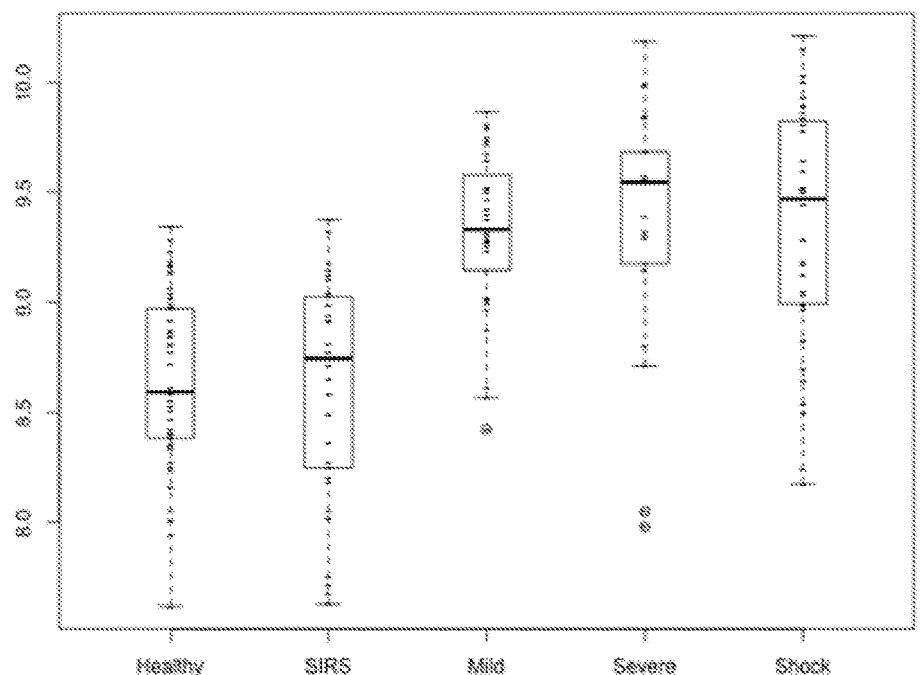
FIG. 111 shows a box and whiskers plot of RCBTB2// LOC100131993 gene expression for healthy subjects and subjects with SIRS, mild sepsis, severe sepsis.
Figure 112:
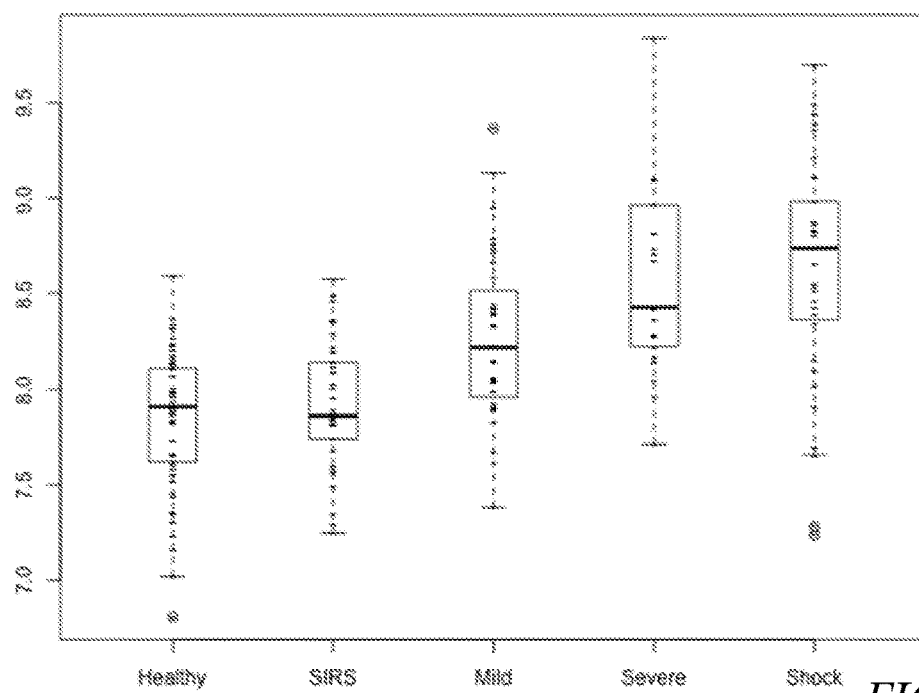
FIG. 112 shows a box and whiskers plot of SEC24A// SAR1B gene expression for healthy subjects and subjects with SIRS, mild sepsis, severe sepsis.
Figure 113:
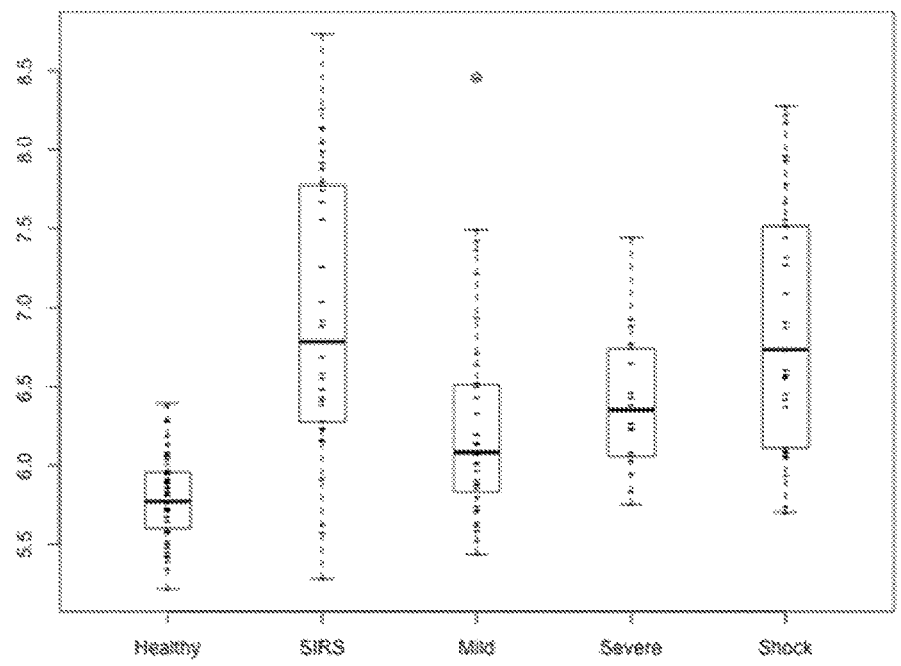
FIG. 113 shows a box and whiskers plot of SH3PXD2B gene expression for healthy subjects and subjects with SIRS, mild sepsis, severe sepsis.
Figure 114:
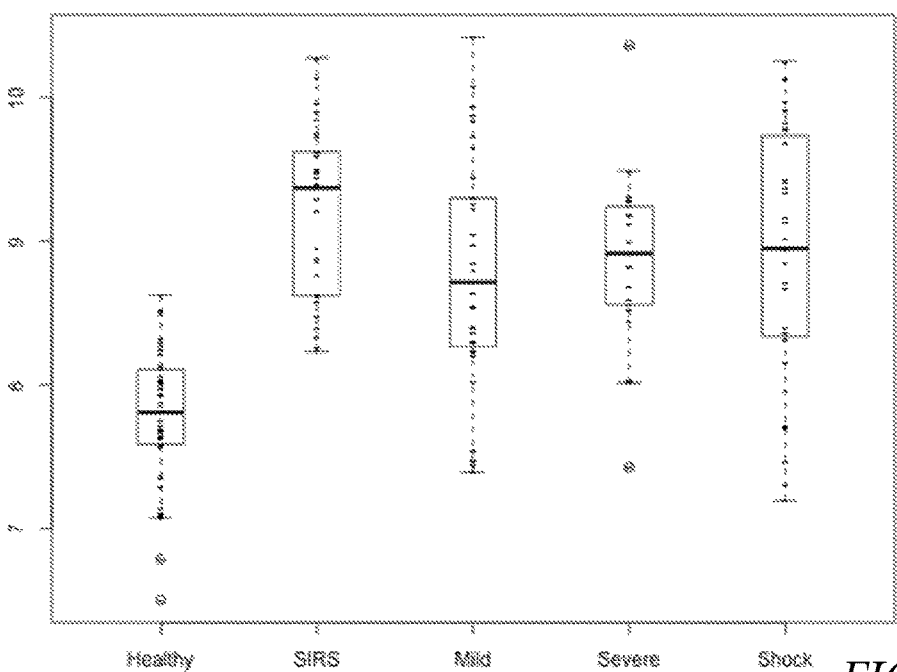
FIG. 114 shows a box and whiskers plot of HMGB2 gene expression for healthy subjects and subjects with SIRS, mild sepsis, severe sepsis.
Figure 115:
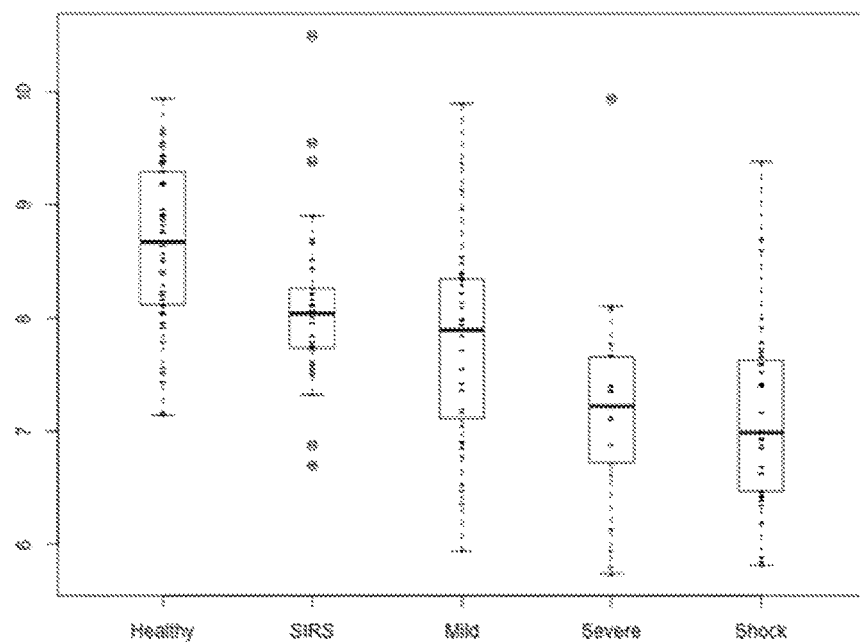
FIG. 115 shows a box and whiskers plot of KLRD1 gene expression for healthy subjects and subjects with SIRS, mild sepsis, severe sepsis.
Figure 116:
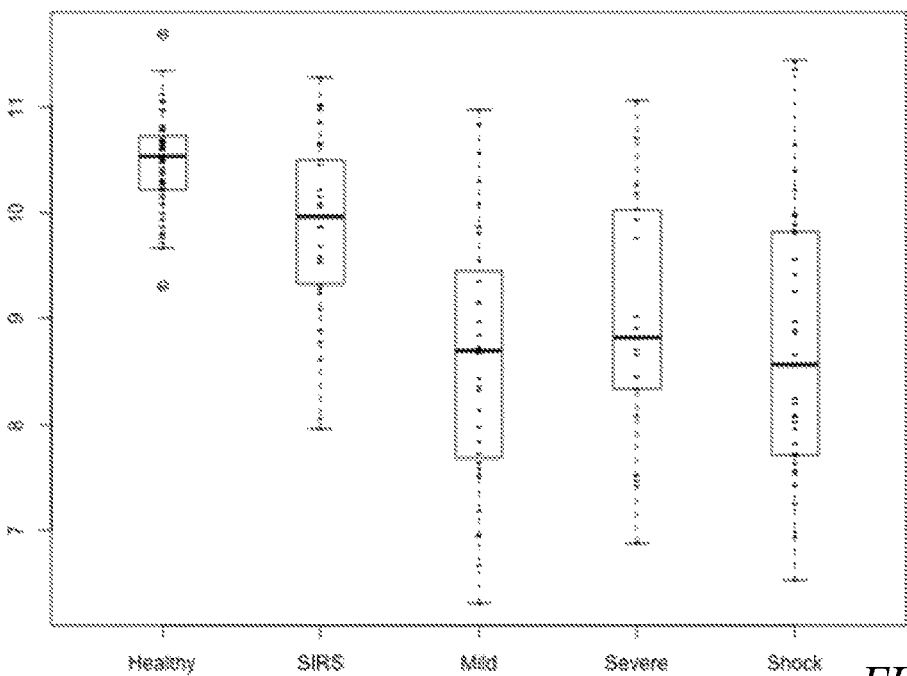
FIG. 116 shows a box and whiskers plot of CHI3L1 gene expression for healthy subjects and subjects with SIRS, mild sepsis, severe sepsis.
Figure 117:
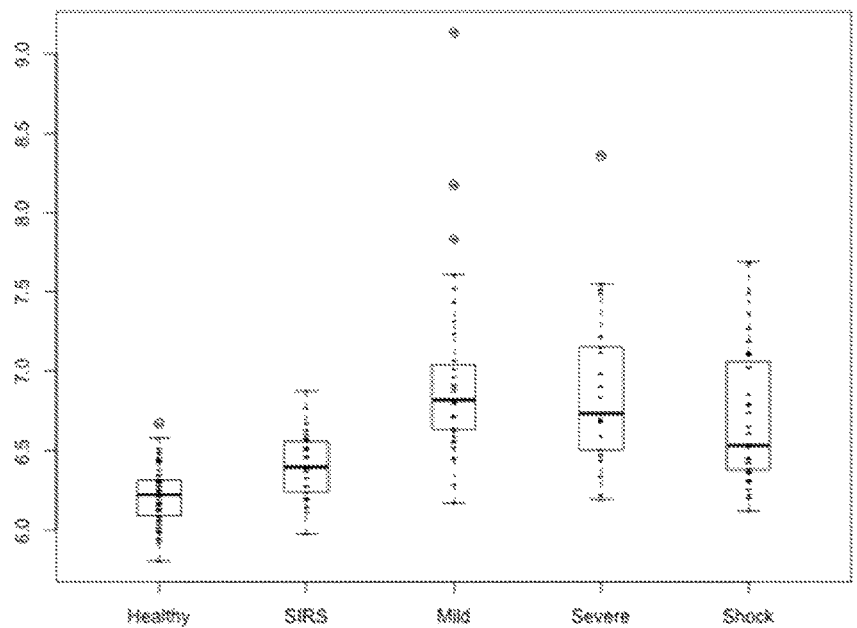
FIG. 117 shows a box and whiskers plot of FRMD3 gene expression for healthy subjects and subjects with SIRS, mild sepsis, severe sepsis.
Figure 118:
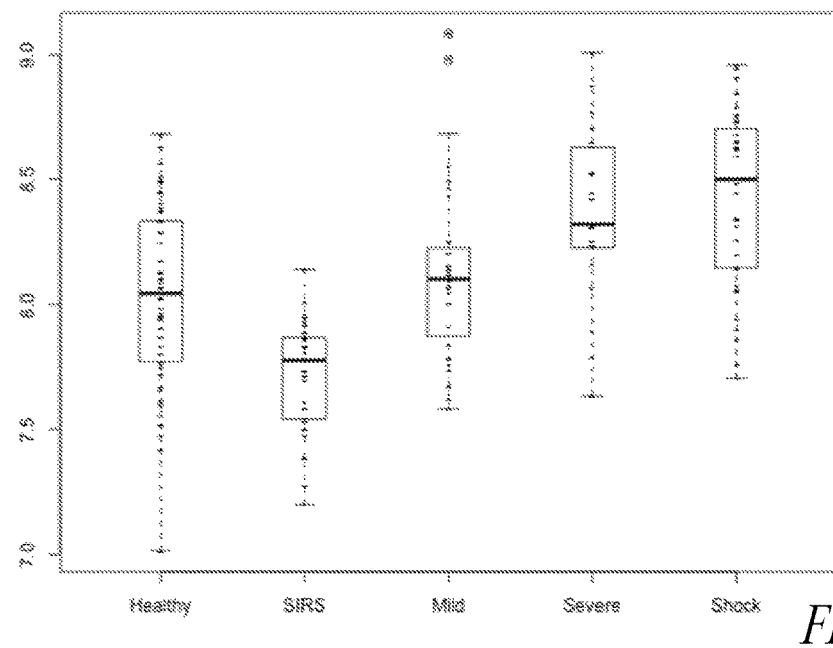
FIG. 118 shows a box and whiskers plot of SLC39A9 gene expression for healthy subjects and subjects with SIRS, mild sepsis, severe sepsis.
Figure 119:
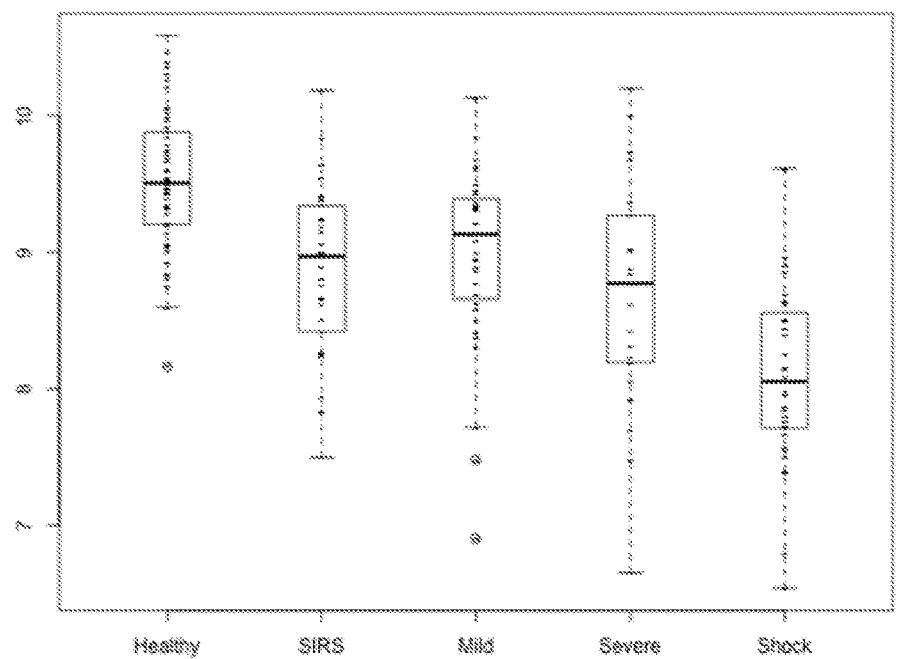
FIG. 119 shows a box and whiskers plot of GIMAP7 gene expression for healthy subjects and subjects with SIRS, mild sepsis, severe sepsis.
Figure 120:
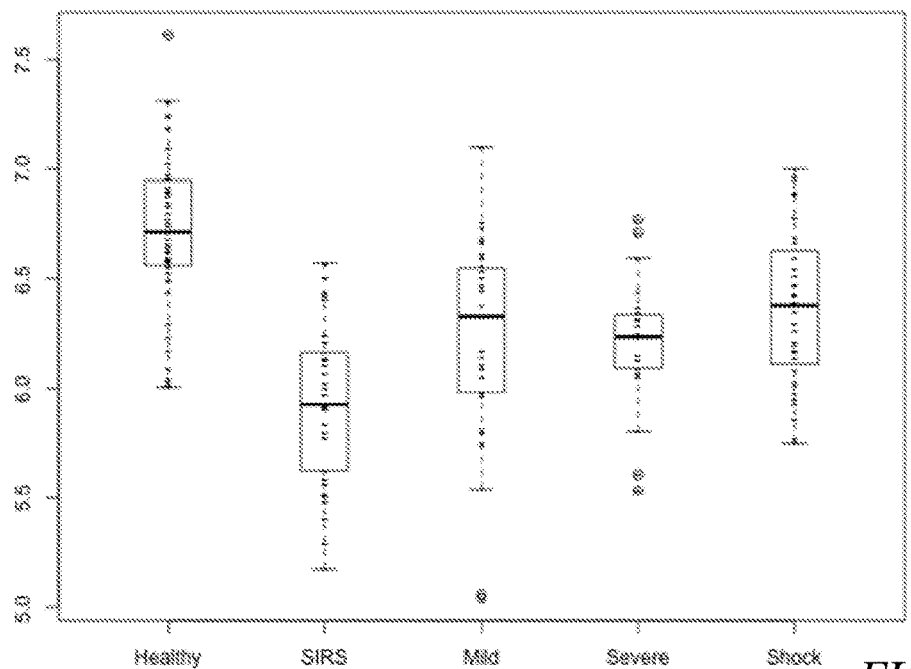
Figure 121:
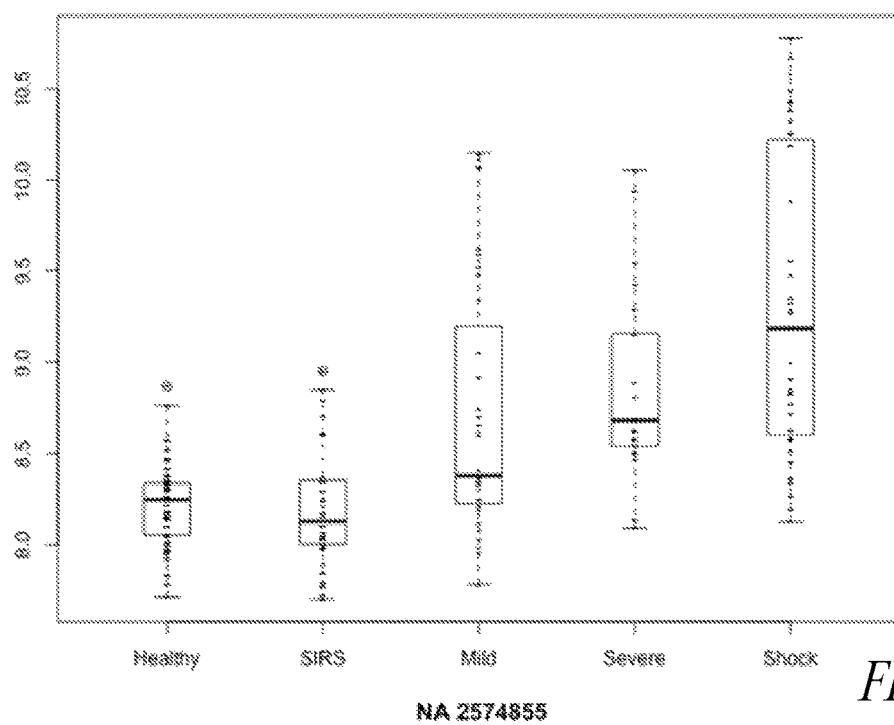
Figure 122:
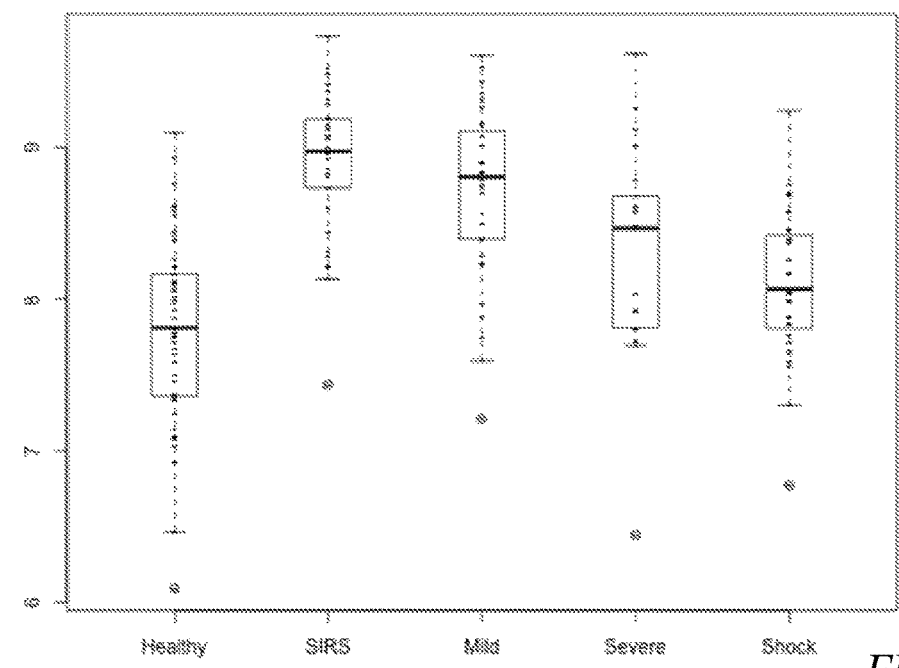
Figure 123:
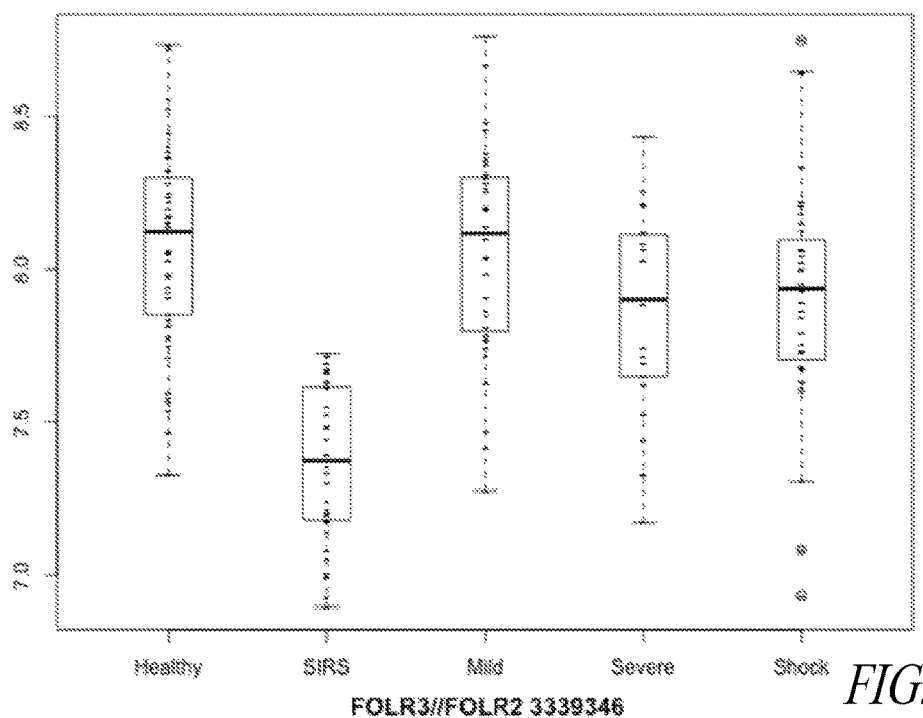
Figure 124:
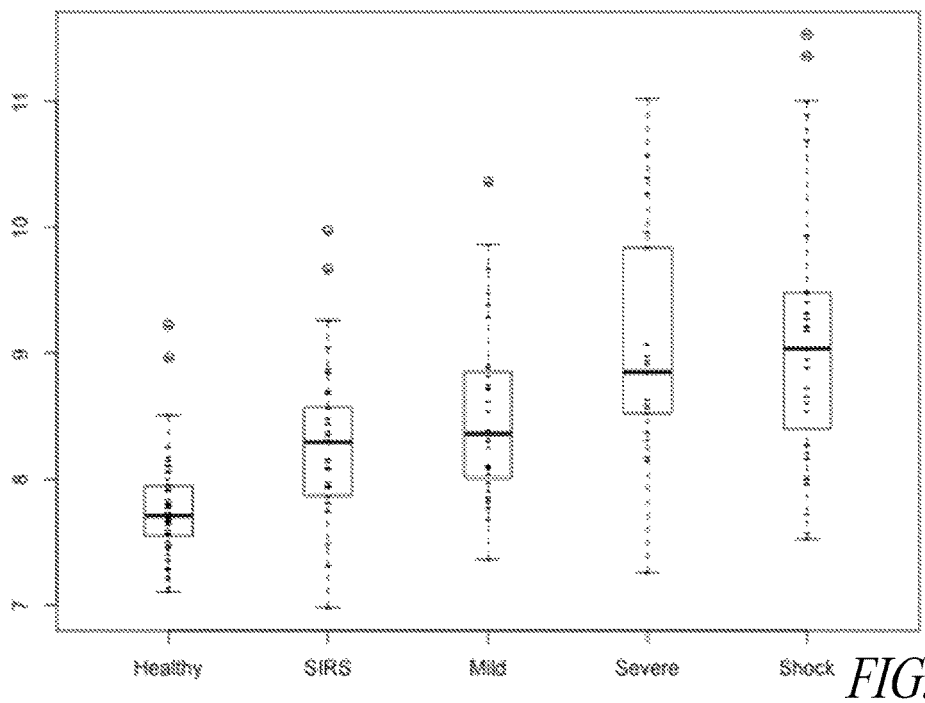
Figure 125:
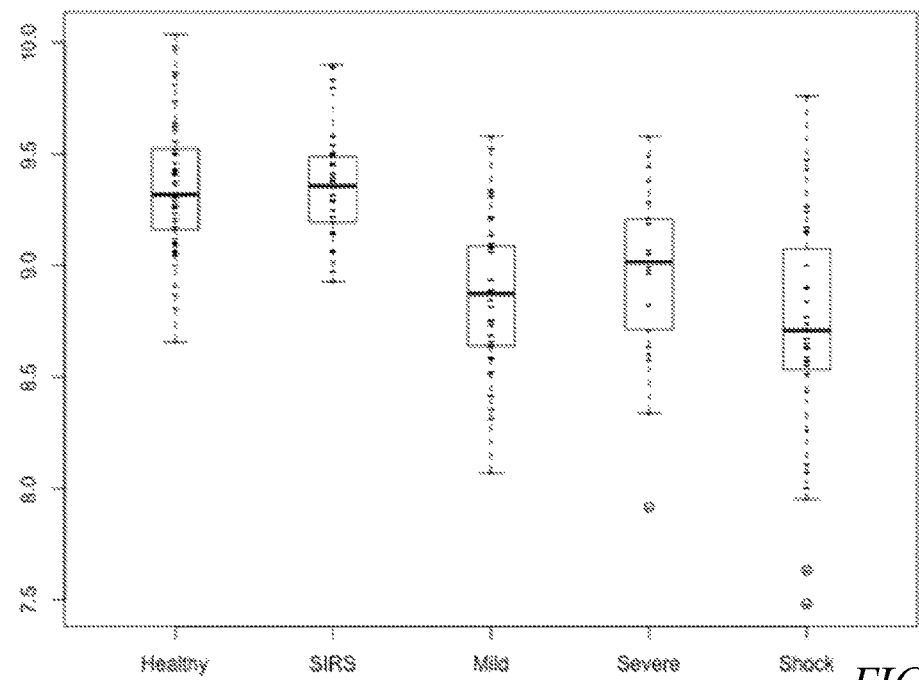
Figure 126:
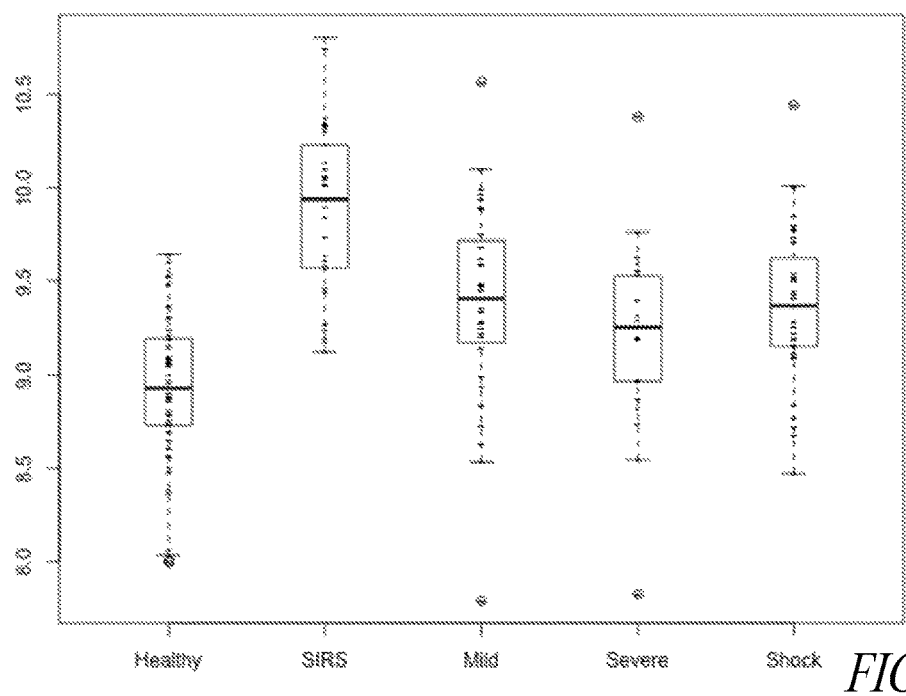
Figure 127:
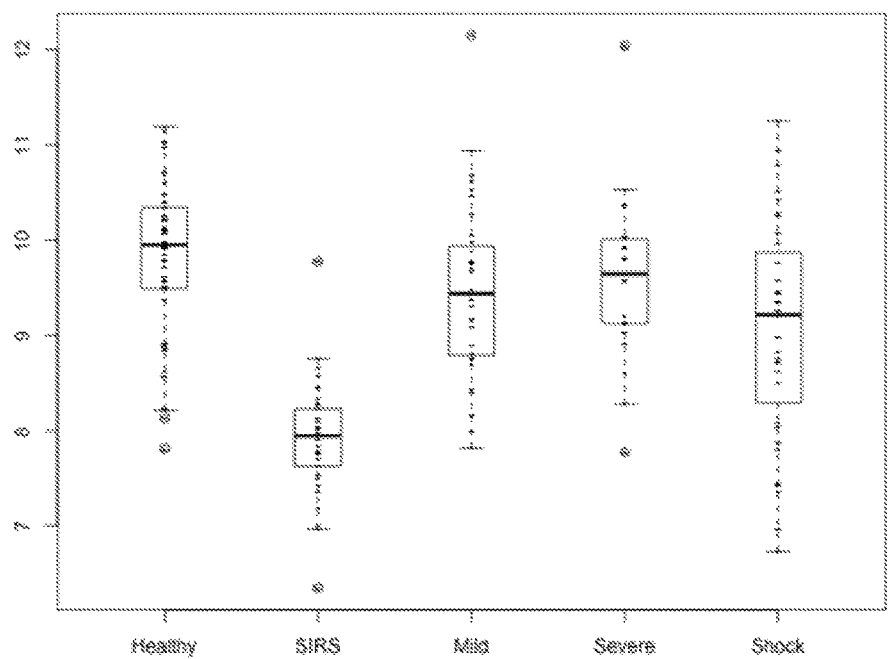
Figure 128:
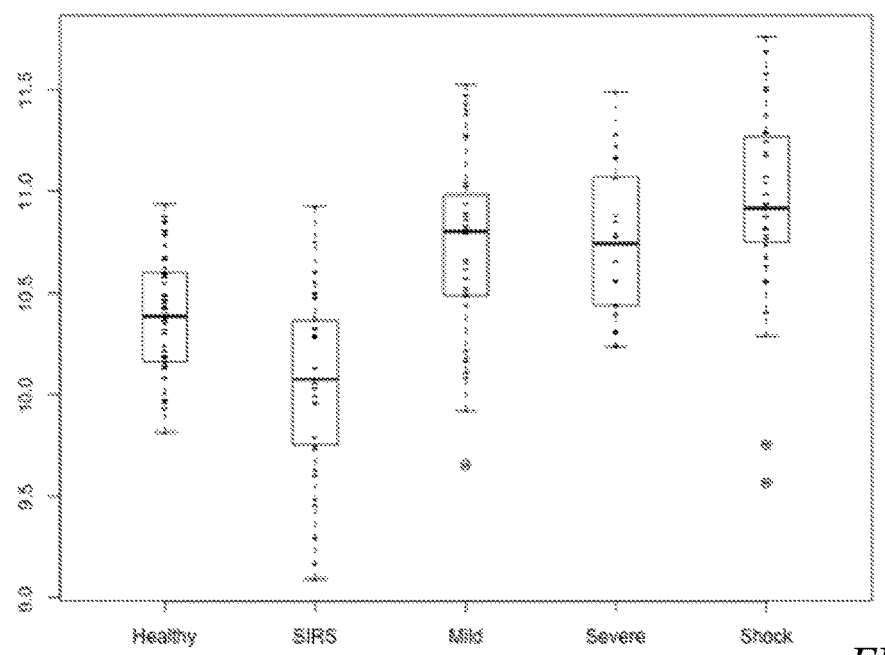
Figure 129:
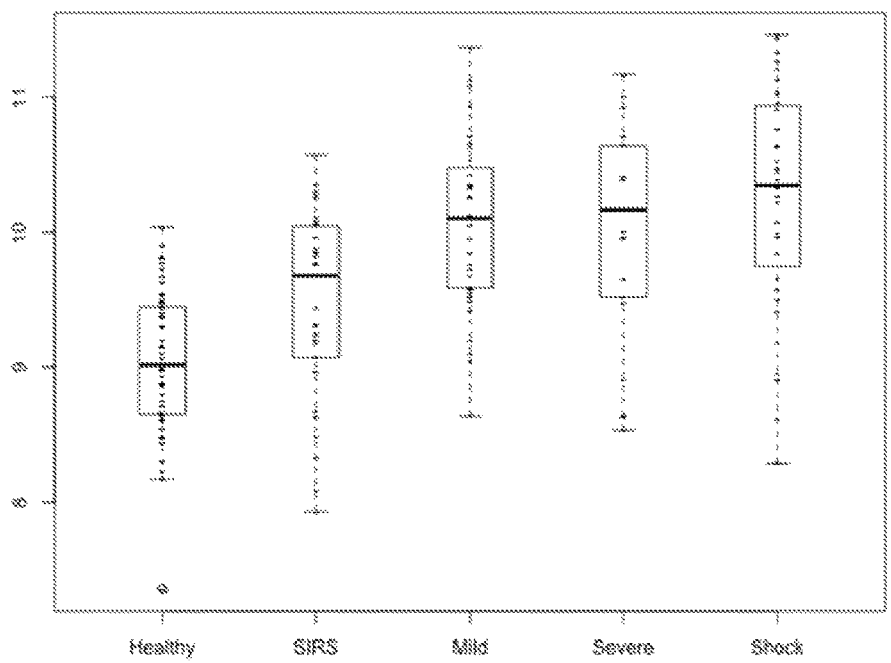
Figure 130:
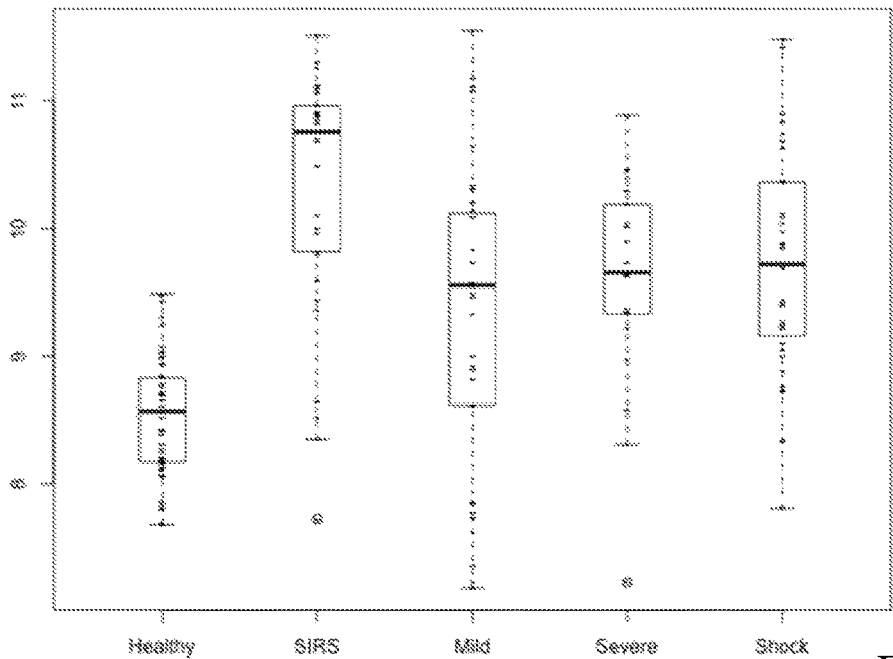
Figure 131:
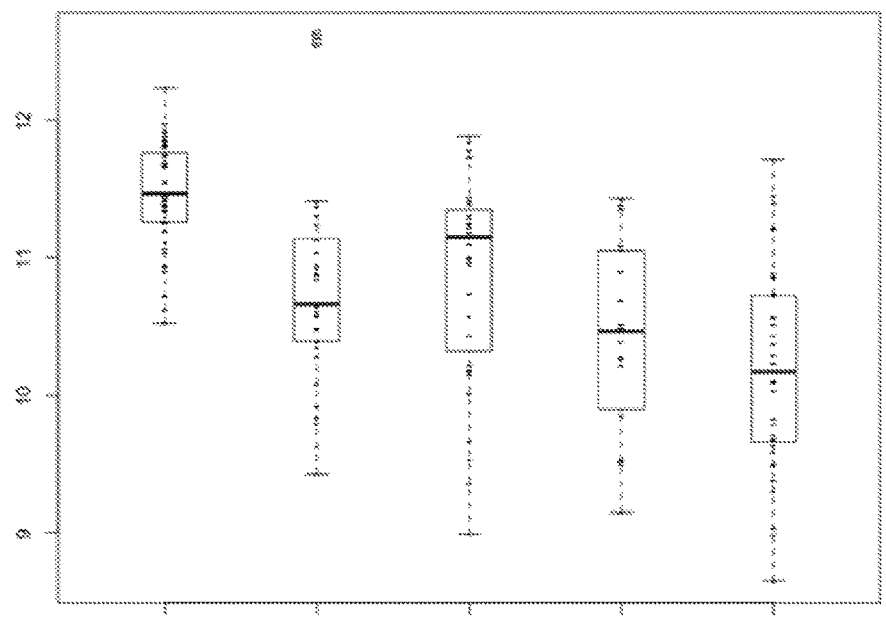

Differential Expression of IRS Biomarkersmarkers Between Healthy, INSIRS, Mild Sepsis, Severe Sepsis and Septic Shock Presented below in FIGS. 13 to 331 are "Box and Whisker" plots for each of the 319 biomarkers where the bottom and top of the box are the first and third quartiles, and the band inside the box is the second quartile (the median) (of gene expression). Biomarkers are presented in order of ascending adjusted p value when comparing "All Classes" (i.e., healthy control, referred to as "Healthy" in FIGS. 13-331; inSIRS, referred to as "SIRS" in FIGS. 13-331; mild sepsis referred to as "Mild" in FIGS. 13-331; severe sepsis, referred to as "Severe" in FIGS. 13-331; and septic shock, referred to as "Shock" in FIGS. 13-331)—varying from 6.49E-48 to 1.00, and according to the following table (Table 15). Appropriate choice and use of such markers can be used to select patients for inclusion in, or exclusion from, clinical trials. Further, such markers can be used to determine the efficacy of treatment, therapies or management regimens in patients by determining whether a patient has transitioned from one condition to another and by determining the stage or degree of a particular condition. For example, an exemplary clinical trial design testing for the efficacy of an inotrope may include only those patients with shock ipSIRS that are most likely to best respond to such a drug. In addition, and following inclusion of such patients and treatment with the inotrope, such patients could be monitored to determine if, when, how quickly and to what degree they respond to the inotrope by their transition from shock ipSIRS to other degrees of ipSIRS, inSIRS or health. Similarly, a model clinical trial design testing for the efficacy of an antibiotic, or combination of antibiotics, may include only those patients with ipSIRS, and not inSIRS, that are most likely to best respond to such a drug. In addition, and following inclusion of such patients and treatment with the antibiotic(s), such patients could be monitored to determine if, when, how quickly and to what degree they respond to the antibiotic(s) by their transition from ipSIRS to inSIRS or health. Similarly, an exemplary clinical trial design testing for the efficacy of an immune modulating drug (e.g. a steroid) may include only those patients with known stages of ipSIRS, for example those recovering from ipSIRS or those in the early stages of ipSIRS. Following inclusion of such patients and treatment with the immune modulating drug, such patients could be monitored to determine if, when, how quickly and to what degree they respond to the immune modulating drug by their transition from ipSIRS to inSIRS or health. The biomarker response and outcome (e.g. reduced length of hospital stay, reduced mortality) of patients in various stages of ipSIRS (early, late) treated with an immune modulating drug may also indicate when such a drug is best administered for maximum benefit.

TABLE 15

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 1 | NM_003268 | TLR5 | 7.747 | 9.010 | 9.726 | 9.979 | 10.311 | 0.000000 | 0.000225 | 0.275728 | 0.000244 | 0.110996 |
| 2 | NM_020406 | CD177 | 8.091 | 10.809 | 11.267 | 12.088 | 12.044 | 0.000000 | 0.087061 | 0.048910 | 0.027926 | 0.991139 |
| 3 | NM_004666 | VNN1 | 7.736 | 10.013 | 10.007 | 10.629 | 10.876 | 0.000000 | 1.000000 | 0.087388 | 0.002402 | 0.671136 |
| 4 | NM_016021 | UBE2J1 | 8.792 | 9.555 | 10.118 | 10.044 | 10.335 | 0.000000 | 0.000015 | 0.817659 | 0.104460 | 0.049488 |
| 5 | NM_018285 | IMP3 | 7.951 | 6.465 | 7.032 | 6.934 | 6.723 | 0.000000 | 0.000000 | 0.645365 | 0.004479 | 0.136619 |
| 6 | NM_002934 | RNASE2 | 9.164 | 10.500 | 11.243 | 11.670 | 11.388 | 0.000000 | 0.002979 | 0.095954 | 0.690976 | 0.351809 |
| 7 | NM_080387 | CLEC4D | 7.187 | 9.915 | 9.238 | 9.152 | 9.828 | 0.000000 | 0.383427 | 0.945300 | 0.034026 | 0.035853 |
| 8 | NM_004054 | C3AR1 | 8.429 | 9.449 | 10.261 | 10.439 | 10.593 | 0.000000 | 0.000016 | 0.650271 | 0.142678 | 0.725241 |
| 9 | NM_001145772 | GPR56 | 9.741 | 8.456 | 8.297 | 7.926 | 7.611 | 0.000000 | 0.009068 | 0.118387 | 0.000147 | 0.212773 |
| 10 | NM_001244438 | ARG1 | 5.410 | 9.054 | 7.895 | 8.254 | 8.919 | 0.000000 | 1.000000 | 0.628534 | 0.008931 | 0.209877 |
| 11 | NR_045213 | FCGR1A | 7.871 | 9.281 | 10.308 | 9.985 | 10.273 | 0.000000 | 0.001046 | 0.284201 | 0.980298 | 0.366022 |
| 12 | NM_145018 | C11orf82 | 5.776 | 5.888 | 6.889 | 7.153 | 7.293 | 0.000000 | 0.000000 | 0.322762 | 0.032568 | 0.722429 |
| 13 | NM_018099 | FAR2 | 8.164 | 8.881 | 9.322 | 9.439 | 9.813 | 0.000000 | 0.000434 | 0.708180 | 0.000658 | 0.034215 |
| 14 | NM_006433 | GNLY | 10.653 | 9.428 | 9.305 | 8.659 | 8.408 | 0.000000 | 0.020098 | 0.014566 | 0.000045 | 0.511511 |
| 15 | NM_004482 | GALNT3 | 5.685 | 6.251 | 6.916 | 6.728 | 7.075 | 0.000000 | 0.000000 | 0.407446 | 0.422801 | 0.051201 |
| 16 | NM_002544 | OMG | 4.756 | 5.187 | 5.644 | 5.799 | 6.063 | 0.000000 | 0.000000 | 0.486295 | 0.001484 | 0.125031 |
| 17 | NM_207113 | SLC37A3 | 8.600 | 10.048 | 9.633 | 9.916 | 9.990 | 0.000000 | 1.000000 | 0.200617 | 0.035680 | 0.892137 |
| 18 | NM_203281 | BMX | 4.804 | 6.547 | 6.012 | 6.397 | 6.839 | 0.000000 | 1.000000 | 0.251812 | 0.000431 | 0.163472 |
| 19 | NM_004099 | STOM | 9.914 | 10.377 | 10.824 | 10.894 | 11.148 | 0.000000 | 0.000000 | 0.861884 | 0.017391 | 0.144729 |
| 20 | NM_153046 | TDRD9 | 4.986 | 5.567 | 6.483 | 6.937 | 7.385 | 0.000000 | 0.000000 | 0.248195 | 0.001153 | 0.259068 |
| 21 | NM_032045 | KREMEN1 | 8.626 | 9.409 | 10.143 | 10.189 | 10.055 | 0.000000 | 0.000079 | 0.962640 | 0.837239 | 0.731337 |
| 22 | NM_005449 | FAIM3 | 10.259 | 9.101 | 9.036 | 9.174 | 8.464 | 0.000000 | 1.000000 | 0.732360 | 0.001453 | 0.000582 |

TABLE 15-continued

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 23 | NM_014358 | CLEC4E | 8.446 | 10.547 | 9.491 | 9.618 | 9.945 | 0.000000 | 0.000082 | 0.796454 | 0.024690 | 0.225126 |
| 24 | NM_003855 | IL18R1 | 5.516 | 8.101 | 7.098 | 7.538 | 8.097 | 0.000000 | 1.000000 | 0.373616 | 0.001873 | 0.205385 |
| 25 | NM_018367 | ACER3 | 7.317 | 7.845 | 8.701 | 8.417 | 9.050 | 0.000000 | 0.000000 | 0.362961 | 0.132905 | 0.008450 |
| 26 | NM_006459 | ERLIN1 | 7.136 | 9.162 | 8.418 | 8.526 | 8.855 | 0.000000 | 0.431436 | 0.880592 | 0.070482 | 0.316561 |
| 27 | NM_004612 | TGFBR1 | 9.328 | 9.614 | 10.165 | 9.999 | 10.368 | 0.000000 | 0.000000 | 0.333550 | 0.115281 | 0.005971 |
| 28 | NM_001145775 | FKBP5 | 9.006 | 11.106 | 10.185 | 10.457 | 10.750 | 0.000000 | 0.035769 | 0.441852 | 0.011707 | 0.389198 |
| 29 | NM_020370 | GPR84 | 6.712 | 8.157 | 9.030 | 8.980 | 9.583 | 0.000000 | 0.001894 | 0.989573 | 0.184680 | 0.221197 |
| 30 | NM_182597 | C7orf53 | 6.397 | 6.878 | 7.266 | 7.760 | 7.532 | 0.000000 | 0.000080 | 0.007994 | 0.141534 | 0.338948 |
| 31 | NM_153021 | PLB1 | 8.205 | 8.887 | 9.574 | 9.463 | 10.019 | 0.000000 | 0.000133 | 0.872838 | 0.059398 | 0.037699 |
| 32 | NM_013352 | DSE | 7.272 | 7.680 | 8.183 | 8.109 | 8.384 | 0.000000 | 0.000062 | 0.830987 | 0.170622 | 0.085371 |
| 33 | NM_000953 | PTGDR | 9.310 | 8.373 | 8.028 | 7.790 | 7.577 | 0.000000 | 0.007043 | 0.500548 | 0.040553 | 0.570947 |
| 34 | NM_001744 | CAMK4 | 8.155 | 6.723 | 6.902 | 7.152 | 6.470 | 0.000000 | 1.000000 | 0.305982 | 0.011176 | 0.000339 |
| 35 | NM_015268 | DNAJC13 | 7.507 | 8.083 | 8.596 | 8.693 | 8.878 | 0.000000 | 0.000000 | 0.833718 | 0.133216 | 0.512817 |
| 36 | NM_007115 | TNFAIP6 | 7.738 | 9.246 | 9.829 | 9.631 | 9.738 | 0.000000 | 1.000000 | 0.712667 | 0.908467 | 0.905260 |
| 37 | NM_199135 | FOXD4L3 | 6.441 | 6.501 | 7.402 | 7.610 | 7.649 | 0.000000 | 0.000000 | 0.417434 | 0.196375 | 0.968937 |
| 38 | NM_004994 | MMP9 | 10.179 | 12.012 | 11.383 | 11.801 | 11.830 | 0.000000 | 1.000000 | 0.196819 | 0.086637 | 0.992129 |
| 39 | NM_000637 | GSR | 8.866 | 9.322 | 9.492 | 10.037 | 9.928 | 0.000000 | 0.000039 | 0.000432 | 0.001207 | 0.709854 |
| 40 | NM_016523 | KLRF1 | 6.343 | 5.438 | 5.022 | 4.504 | 4.543 | 0.000000 | 0.007278 | 0.033428 | 0.021421 | 0.979558 |
| 41 | NM_053282 | SH2D1B | 8.067 | 6.992 | 6.896 | 6.451 | 6.450 | 0.000000 | 0.652812 | 0.064249 | 0.026676 | 0.999993 |
| 42 | NM_001004441 | ANKRD34B | 4.809 | 5.415 | 5.855 | 6.471 | 6.738 | 0.000000 | 0.000000 | 0.074815 | 0.001252 | 0.606835 |
| 43 | NM_001136258 | SGMS2 | 6.693 | 7.708 | 7.553 | 7.712 | 8.128 | 0.000000 | 1.000000 | 0.670176 | 0.001769 | 0.073073 |
| 44 | NM_032047 | B3GNT5 | 6.871 | 8.033 | 8.009 | 7.744 | 8.548 | 0.000000 | 1.000000 | 0.438630 | 0.013149 | 0.000955 |
| 45 | NR_026575 | GK3P | 4.227 | 5.729 | 5.316 | 5.552 | 5.937 | 0.000000 | 1.000000 | 0.493837 | 0.002433 | 0.158402 |
| 46 | NM_006212 | PFKFB2 | 7.955 | 10.444 | 9.336 | 9.326 | 10.196 | 0.000000 | 0.069041 | 0.999591 | 0.014557 | 0.037351 |
| 47 | NM_007166 | PICALM | 9.079 | 9.433 | 9.822 | 9.993 | 10.284 | 0.000000 | 0.000000 | 0.500534 | 0.001958 | 0.138243 |
| 48 | NM_152637 | METTL7B | 6.693 | 7.598 | 7.628 | 7.927 | 8.037 | 0.000000 | 0.000000 | 0.315445 | 0.060594 | 0.854279 |
| 49 | NM_003542 | HIST1H4C | 11.803 | 9.795 | 10.815 | 10.617 | 10.323 | 0.000000 | 0.000000 | 0.695152 | 0.055254 | 0.448113 |
| 50 | NM_145005 | C9orf72 | 8.262 | 8.742 | 9.312 | 9.073 | 9.243 | 0.000000 | 0.000039 | 0.180477 | 0.821921 | 0.417016 |
| 51 | NM_003533 | HIST1H3I | 10.878 | 9.003 | 10.144 | 10.141 | 9.669 | 0.000000 | 0.000000 | 0.999875 | 0.029147 | 0.070614 |
| 52 | NM_021082 | SLC15A2 | 7.246 | 7.309 | 7.861 | 8.034 | 8.227 | 0.000000 | 0.000000 | 0.350572 | 0.002949 | 0.273300 |
| 53 | NM_030956 | TLR10 | 6.794 | 6.842 | 7.713 | 7.823 | 7.900 | 0.000000 | 0.000000 | 0.798408 | 0.423055 | 0.895263 |
| 54 | NM_001124 | ADM | 8.676 | 8.896 | 9.739 | 9.441 | 9.674 | 0.000000 | 0.000001 | 0.091052 | 0.855508 | 0.225820 |
| 55 | NM_014143 | CD274 | 5.508 | 5.656 | 7.557 | 7.211 | 7.237 | 0.000000 | 0.000000 | 0.536662 | 0.490374 | 0.996684 |
| 56 | NM_001311 | CRIP1 | 8.880 | 6.932 | 7.984 | 7.844 | 7.526 | 0.000000 | 0.002476 | 0.799183 | 0.046887 | 0.320589 |
| 57 | NM_001099660 | LRRN3 | 7.163 | 5.997 | 5.841 | 6.367 | 5.906 | 0.000000 | 1.000000 | 0.002710 | 0.877917 | 0.009767 |
| 58 | NM_002121 | HLA-DPB1 | 11.414 | 10.665 | 10.623 | 9.971 | 9.578 | 0.000000 | 0.067333 | 0.026428 | 0.000013 | 0.253098 |
| 59 | NM_014232 | VAMP2 | 9.213 | 8.896 | 9.016 | 8.454 | 8.353 | 0.000000 | 0.297018 | 0.000084 | 0.000000 | 0.708038 |
| 60 | NM_006714 | SMPDL3A | 6.243 | 6.701 | 7.288 | 7.563 | 8.227 | 0.000000 | 0.000000 | 0.609142 | 0.000879 | 0.060210 |
| 61 | NM_005531 | IFI16 | 8.973 | 10.323 | 9.950 | 9.942 | 9.860 | 0.000000 | 0.020087 | 0.998663 | 0.799026 | 0.869508 |
| 62 | NM_016475 | JKAMP | 8.440 | 8.442 | 9.231 | 8.827 | 9.150 | 0.000000 | 0.000000 | 0.000984 | 0.661905 | 0.010409 |
| 63 | ENST00000371443 | MRPL41 | 8.037 | 6.496 | 7.288 | 7.313 | 7.279 | 0.000000 | 0.000000 | 0.986016 | 0.997776 | 0.974877 |
| 64 | NM_004172 | SLC1A3 | 5.849 | 6.892 | 6.472 | 6.447 | 7.373 | 0.000000 | 1.000000 | 0.993673 | 0.000056 | 0.000352 |
| 65 | NM_006418 | OLFM4 | 6.365 | 7.209 | 8.023 | 9.641 | 9.322 | 0.000000 | 0.000068 | 0.003150 | 0.006691 | 0.784808 |
| 66 | NM_001164116 | CASS4 | 8.124 | 7.848 | 7.410 | 7.217 | 7.047 | 0.000000 | 0.000000 | 0.428924 | 0.022397 | 0.521806 |
| 67 | ENST00000533734 | TCN1 | 6.015 | 6.936 | 7.241 | 8.481 | 8.420 | 0.000000 | 0.000000 | 0.000290 | 0.005182 | 0.001932 | 0.986095 |
| 68 | NM_018639 | WSB2 | 8.870 | 8.808 | 9.618 | 9.714 | 9.657 | 0.000000 | 0.000000 | 0.761189 | 0.939475 | 0.910197 |
| 69 | ENST00000405140 | CLU | 9.016 | 9.264 | 9.889 | 10.137 | 9.813 | 0.000000 | 0.000063 | 0.216377 | 0.819582 | 0.075588 |
| 70 | NM_001163278 | ODZ1 | 6.088 | 7.677 | 6.668 | 7.303 | 7.416 | 0.000000 | 0.245652 | 0.024855 | 0.001421 | 0.884318 |
| 71 | NM_002269 | KPNA5 | 6.822 | 5.908 | 6.451 | 5.758 | 5.712 | 0.000000 | 1.000000 | 0.000021 | 0.000000 | 0.945115 |
| 72 | NM_001130715 | PLAC8 | 10.873 | 10.024 | 11.434 | 11.500 | 11.772 | 1.000000 | 0.000000 | 0.950268 | 0.172935 | 0.420732 |
| 73 | NM_001257400 | CD63 | 9.235 | 9.126 | 9.718 | 9.990 | 10.159 | 0.000000 | 0.000000 | 0.156468 | 0.002260 | 0.485665 |
| 74 | NM_006665 | HPSE | 8.103 | 8.173 | 9.127 | 9.174 | 8.937 | 0.000000 | 0.000000 | 0.958822 | 0.401504 | 0.346256 |
| 75 | NM_152367 | C1orf161 | 5.851 | 6.354 | 6.479 | 6.738 | 6.845 | 0.000000 | 0.417891 | 0.196267 | 0.015671 | 0.756446 |
| 76 | ENST00000443533 | DDAH2 | 8.067 | 8.170 | 8.630 | 8.707 | 9.015 | 0.000000 | 0.000000 | 0.868573 | 0.011535 | 0.108528 |
| 77 | NM_001199805 | KLRK1 | 8.677 | 7.641 | 7.492 | 7.142 | 6.815 | 0.000000 | 1.000000 | 0.344640 | 0.006675 | 0.394595 |
| 78 | NM_024524 | ATP13A3 | 7.668 | 7.763 | 8.429 | 8.547 | 8.804 | 0.000000 | 0.000000 | 0.777976 | 0.039725 | 0.310273 |
| 79 | NM_005546 | ITK | 9.271 | 8.099 | 8.227 | 8.536 | 7.635 | 0.000000 | 1.000000 | 0.276607 | 0.002832 | 0.000063 |
| 80 | NM_021127 | PMAIP1 | 6.940 | 5.860 | 6.770 | 6.251 | 6.214 | 0.000000 | 0.002936 | 0.000187 | 0.968287 |
| 81 | NR_046099 | LOC284757 | 6.913 | 8.028 | 6.894 | 7.534 | 7.376 | 0.000001 | 0.000004 | 0.000039 | 0.000364 | 0.493398 |
| 82 | NM_002080 | GOT2 | 6.854 | 5.853 | 6.017 | 6.378 | 6.047 | 0.000000 | 0.490985 | 0.040847 | 0.969911 | 0.066504 |
| 83 | NR_036641 | PDGFC | 6.098 | 6.117 | 6.987 | 7.044 | 7.466 | 0.000000 | 0.970637 | 0.064634 | 0.196970 |
| 84 | NM_012200 | B3GAT3 | 7.939 | 7.030 | 7.516 | 7.658 | 7.632 | 0.000000 | 0.387020 | 0.434149 | 0.966275 |
| 85 | NM_003545 | HIST1H4E | 10.534 | 9.717 | 9.907 | 9.362 | 9.307 | 0.000000 | 1.000000 | 0.026325 | 0.003375 | 0.962707 |
| 86 | NM_000860 | HPGD | 5.621 | 6.238 | 7.085 | 6.908 | 7.946 | 0.000000 | 0.000024 | 0.895298 | 0.035905 | 0.027021 |
| 87 | NM_031950 | FGFBP2 | 8.090 | 7.266 | 7.130 | 6.722 | 6.520 | 0.000000 | 0.976589 | 0.222869 | 0.013639 | 0.687542 |
| 88 | NM_181506 | LRRC70 | 3.455 | 3.495 | 4.144 | 3.763 | 4.135 | 0.000000 | 0.000000 | 0.020091 | 0.996732 | 0.024012 |
| 89 | NM_018342 | TMEM144 | 5.697 | 6.377 | 6.781 | 7.043 | 6.824 | 0.000000 | 0.914921 | 0.404820 | 0.968067 | 0.529328 |
| 90 | gi|21749325 | CDS2 | 10.235 | 9.988 | 10.651 | 10.561 | 10.570 | 0.041844 | 0.000000 | 0.584395 | 0.561379 | 0.994393 |
| 91 | NM_001725 | BPI | 7.724 | 8.603 | 8.894 | 10.119 | 9.589 | 0.000000 | 0.026705 | 0.001145 | 0.046592 | 0.253799 |

TABLE 15-continued

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 92 | ENST00000379215 | ECHDC3 | 7.486 | 8.705 | 7.801 | 7.715 | 8.165 | 0.000000 | 0.001975 | 0.857762 | 0.030361 | 0.018763 |
| 93 | NM_001837 | CCR3 | 7.078 | 6.226 | 6.015 | 6.079 | 5.783 | 0.000000 | 1.000000 | 0.937302 | 0.322103 | 0.253166 |
| 94 | NM_014181 | HSPC159 | 9.120 | 9.779 | 9.933 | 10.248 | 10.249 | 0.000000 | 1.000000 | 0.218914 | 0.132537 | 0.999989 |
| 95 | NM_018324 | OLAH | 4.483 | 6.220 | 5.483 | 6.162 | 6.492 | 0.000000 | 1.000000 | 0.125688 | 0.003063 | 0.604976 |
| 96 | NM_006243 | PPP2R5A | 8.141 | 9.000 | 8.646 | 8.931 | 8.952 | 0.000000 | 1.000000 | 0.109345 | 0.035683 | 0.988342 |
| 97 | NM_001193451 | TMTC1 | 6.316 | 7.153 | 7.497 | 7.783 | 7.961 | 0.000000 | 0.543009 | 0.580949 | 0.154696 | 0.809916 |
| 98 | NM_001023570 | EAF2 | 8.389 | 8.607 | 9.323 | 9.016 | 9.301 | 0.000000 | 0.000012 | 0.105531 | 0.985106 | 0.141523 |
| 99 | NM_001268 | RCBTB2 | 8.646 | 8.621 | 9.321 | 9.357 | 9.340 | 0.000000 | 0.000001 | 0.961397 | 0.985058 | 0.991536 |
| 100 | NM_021982 | SEC24A | 7.847 | 7.814 | 8.266 | 8.571 | 8.641 | 0.000000 | 0.000000 | 0.094884 | 0.010201 | 0.880791 |
| 101 | NM_001017995 | SH3PXD2B | 5.800 | 6.949 | 6.262 | 6.384 | 6.870 | 0.000000 | 1.000000 | 0.786615 | 0.000756 | 0.026622 |
| 102 | NM_001130688 | HMGB2 | 7.782 | 9.225 | 8.769 | 8.869 | 8.910 | 0.000000 | 1.000000 | 0.894388 | 0.745151 | 0.981575 |
| 103 | ENST00000381907 | KLRD1 | 8.651 | 8.097 | 7.766 | 7.201 | 7.123 | 0.000000 | 0.011838 | 0.056985 | 0.008125 | 0.944270 |
| 104 | NM_001276 | CHI3L1 | 10.470 | 9.876 | 8.640 | 9.035 | 8.726 | 0.000000 | 0.000056 | 0.485576 | 0.954853 | 0.641602 |
| 105 | NM_174938 | FRMD3 | 6.218 | 6.408 | 6.959 | 6.889 | 6.703 | 0.000000 | 0.000000 | 0.872556 | 0.096505 | 0.389383 |
| 106 | NM_018375 | SLC39A9 | 8.038 | 7.719 | 8.121 | 8.368 | 8.428 | 1.000000 | 0.000000 | 0.034062 | 0.001276 | 0.808136 |
| 107 | NM_153236 | GIMAP7 | 9.533 | 8.865 | 8.974 | 8.682 | 8.112 | 0.000000 | 1.000000 | 0.310769 | 0.000008 | 0.014285 |
| 108 | NM_016476 | ANAPC11 | 6.716 | 5.940 | 6.219 | 6.214 | 6.368 | 0.000000 | 0.016248 | 0.998808 | 0.245788 | 0.323554 |
| 109 | NM_019037 | EXOSC4 | 8.216 | 8.199 | 8.716 | 8.845 | 9.307 | 0.000000 | 0.000000 | 0.796042 | 0.002754 | 0.059157 |
| 110 | 0113182974 | NA | 7.793 | 8.895 | 8.712 | 8.321 | 8.114 | 0.000000 | 0.003518 | 0.039103 | 0.000094 | 0.391472 |
| 111 | NM_198336 | INSIG1 | 8.081 | 7.370 | 8.062 | 7.867 | 7.913 | 0.001237 | 0.000000 | 0.123875 | 0.197540 | 0.883915 |
| 112 | ENST00000542161 | FOLR3 | 7.767 | 8.283 | 8.505 | 9.059 | 9.163 | 0.000000 | 0.039807 | 0.074391 | 0.008772 | 0.909407 |
| 113 | NM_001024630 | RUNX2 | 9.359 | 9.363 | 8.874 | 8.973 | 8.703 | 0.000000 | 0.000000 | 0.683914 | 0.223731 | 0.064525 |
| 114 | NM_018457 | PRR13 | 8.919 | 9.881 | 9.380 | 9.204 | 9.375 | 0.000000 | 0.000085 | 0.390820 | 0.998964 | 0.411767 |
| 115 | NM_003546 | HIST1H4L | 9.807 | 7.908 | 9.466 | 9.602 | 9.065 | 0.000032 | 0.000000 | 0.878290 | 0.231084 | 0.140998 |
| 116 | NM_002305 | LGALS1 | 10.393 | 10.059 | 10.730 | 10.741 | 10.938 | 0.246894 | 0.000000 | 0.995433 | 0.137821 | 0.261564 |
| 117 | NM_001295 | CCR1 | 9.036 | 9.458 | 10.071 | 10.000 | 10.253 | 0.000000 | 0.009681 | 0.937695 | 0.574455 | 0.448234 |
| 118 | NM_003596 | TPST1 | 8.526 | 10.334 | 9.295 | 9.600 | 9.760 | 0.000000 | 0.055822 | 0.518907 | 0.136190 | 0.833502 |
| 119 | NM_019111 | HLA-DRA | 11.467 | 10.758 | 10.870 | 10.441 | 10.188 | 0.000000 | 1.000000 | 0.091925 | 0.000575 | 0.429491 |
| 120 | NM_004244 | CD163 | 6.823 | 8.730 | 7.652 | 7.643 | 8.413 | 0.000000 | 0.092636 | 0.999632 | 0.037288 | 0.077812 |
| 121 | NM_005306 | FFAR2 | 9.559 | 9.849 | 10.479 | 10.309 | 10.573 | 0.000000 | 0.002329 | 0.564897 | 0.791331 | 0.256398 |
| 122 | NM_001143804 | PHOSPHO1 | 11.398 | 10.826 | 10.374 | 9.837 | 10.185 | 0.000000 | 0.048380 | 0.088690 | 0.661703 | 0.354179 |
| 123 | NM_005729 | PPIF | 9.131 | 8.392 | 8.994 | 8.669 | 8.682 | 0.000000 | 0.001262 | 0.016029 | 0.006615 | 0.993122 |
| 124 | NM_001199760 | MTHFS | 8.177 | 9.060 | 8.644 | 8.530 | 8.897 | 0.000000 | 0.406481 | 0.678016 | 0.086391 | 0.022355 |
| 125 | NM_015190 | DNAJC9 | 7.382 | 5.889 | 6.594 | 7.251 | 6.665 | 0.000000 | 0.000027 | 0.007512 | 0.921502 | 0.019348 |
| 126 | NM_005564 | LCN2 | 7.729 | 8.168 | 8.921 | 10.113 | 10.092 | 0.000000 | 0.000002 | 0.028722 | 0.011016 | 0.998889 |
| 127 | ENST00000233057 | EIF2AK2 | 7.237 | 8.670 | 8.347 | 8.159 | 8.071 | 0.000000 | 0.263528 | 0.709245 | 0.379350 | 0.929139 |
| 128 | NM_006498 | LGALS2 | 6.920 | 6.085 | 6.594 | 6.235 | 6.142 | 0.000000 | 0.375827 | 0.045528 | 0.001960 | 0.806041 |
| 129 | NM_001199922 | SIAE | 6.721 | 6.530 | 7.174 | 7.284 | 7.068 | 0.000300 | 0.000000 | 0.666202 | 0.603123 | 0.213378 |
| 130 | NM_004644 | AP3B2 | 5.979 | 6.181 | 6.485 | 6.665 | 7.116 | 0.000000 | 0.000003 | 0.646507 | 0.001477 | 0.071475 |
| 131 | NM_152701 | ABCA13 | 5.814 | 6.131 | 6.688 | 7.350 | 7.182 | 0.000000 | 0.000000 | 0.066387 | 0.130673 | 0.834277 |
| 132 | gi|21757933 | NA | 7.336 | 7.963 | 7.065 | 7.340 | 7.275 | 1.000000 | 0.000000 | 0.034322 | 0.071492 | 0.818353 |
| 133 | NR_026586 | EFCAB2 | 4.462 | 4.942 | 5.648 | 4.939 | 5.021 | 0.000000 | 1.000000 | 0.000756 | 0.000575 | 0.898330 |
| 134 | NM_170745 | HIST1H2AA | 6.310 | 6.726 | 6.483 | 6.652 | 6.820 | 0.000002 | 0.020011 | 0.118625 | 0.000044 | 0.124349 |
| 135 | NR_024610 | HINT1 | 7.948 | 6.705 | 7.591 | 7.235 | 7.052 | 0.000000 | 0.041290 | 0.142709 | 0.003549 | 0.590766 |
| 136 | NM_003535 | HIST1H3J | 8.323 | 6.703 | 7.484 | 7.314 | 7.135 | 0.000000 | 0.000274 | 0.715862 | 0.160141 | 0.691744 |
| 137 | NM_001785 | CDA | 10.407 | 11.415 | 11.045 | 11.032 | 11.020 | 0.000000 | 0.043371 | 0.996584 | 0.982475 | 0.996794 |
| 138 | NM_003864 | SAP30 | 9.022 | 8.919 | 9.258 | 9.251 | 9.295 | 0.000000 | 0.001328 | 0.998061 | 0.924872 | 0.921435 |
| 139 | NM_001040196 | AGTRAP | 10.055 | 9.933 | 10.594 | 10.356 | 10.502 | 0.000787 | 0.000000 | 0.083006 | 0.602023 | 0.382046 |
| 140 | NM_033050 | SUCNR1 | 3.660 | 3.734 | 4.329 | 4.517 | 4.334 | 0.000000 | 0.000000 | 0.487465 | 0.999396 | 0.504866 |
| 141 | NM_002454 | MTRR | 8.163 | 7.862 | 8.523 | 8.796 | 8.849 | 0.122045 | 0.000000 | 0.216837 | 0.057755 | 0.942570 |
| 142 | NM_001168357 | PLA2G7 | 6.797 | 6.685 | 5.928 | 5.753 | 5.816 | 0.000000 | 0.011194 | 0.534519 | 0.708535 | 0.921793 |
| 143 | NM_016108 | AIG1 | 6.298 | 6.806 | 6.932 | 6.735 | 7.005 | 0.000001 | 0.000000 | 0.470358 | 0.871019 | 0.246707 |
| 144 | NM_013363 | PCOLCE2 | 5.863 | 5.909 | 6.292 | 6.366 | 6.785 | 0.000000 | 0.000000 | 0.925694 | 0.013235 | 0.089534 |
| 145 | NM_080491 | GAB2 | 9.471 | 10.280 | 9.787 | 9.810 | 9.689 | 0.000000 | 0.000000 | 0.982341 | 0.635805 | 0.599323 |
| 146 | NM_012262 | HS2ST1 | 7.018 | 6.874 | 7.363 | 7.378 | 7.465 | 0.001571 | 0.000000 | 0.990909 | 0.556564 | 0.723490 |
| 147 | NM_003529 | HIST1H3A | 7.822 | 6.477 | 7.240 | 7.007 | 6.871 | 0.000000 | 0.000513 | 0.477800 | 0.090217 | 0.776827 |
| 148 | gi|21757754 | C22orf37 | 8.047 | 7.525 | 8.170 | 7.898 | 7.869 | 0.152851 | 0.000000 | 0.021435 | 0.002302 | 0.954990 |
| 149 | ENST00000443117 | HLA-DPA1 | 11.917 | 11.327 | 11.426 | 10.930 | 10.582 | 0.000000 | 1.000000 | 0.125876 | 0.000597 | 0.352649 |
| 150 | NM_030796 | VOPP1 | 9.302 | 8.771 | 9.510 | 9.318 | 9.517 | 1.000000 | 0.000000 | 0.298375 | 0.997162 | 0.269787 |
| 151 | NM_001135147 | SLC39A8 | 7.820 | 7.364 | 8.061 | 7.951 | 8.434 | 1.000000 | 0.000000 | 0.788039 | 0.031226 | 0.013434 |
| 152 | NM_002417 | MKI67 | 5.979 | 5.822 | 6.140 | 6.894 | 6.463 | 0.105108 | 0.000000 | 0.000163 | 0.097385 | 0.045251 |
| 153 | NM_000578 | SLC11A1 | 10.812 | 11.719 | 11.333 | 11.110 | 11.214 | 0.000000 | 0.000048 | 0.338648 | 0.659426 | 0.788341 |
| 154 | NM_001657 | AREG | 6.075 | 6.298 | 6.139 | 6.126 | 6.310 | 0.001304 | 0.023771 | 0.980680 | 0.018616 | 0.030209 |
| 155 | NM_005502 | ABCA1 | 7.734 | 7.909 | 8.601 | 8.816 | 8.449 | 0.000000 | 0.000000 | 0.574359 | 0.692624 | 0.204976 |
| 156 | NM_001201427 | DAAM2 | 6.591 | 8.217 | 7.135 | 7.167 | 7.607 | 0.000000 | 0.072069 | 0.992564 | 0.124949 | 0.254325 |
| 157 | NM_002343 | LTF | 8.098 | 8.330 | 8.923 | 9.937 | 9.639 | 0.000000 | 0.000019 | 0.012909 | 0.052398 | 0.670808 |
| 158 | NM_178174 | TREML1 | 8.869 | 9.169 | 9.868 | 10.187 | 9.876 | 0.000000 | 0.000638 | 0.449927 | 0.999311 | 0.468015 |
| 159 | NM_004832 | GSTO1 | 7.113 | 7.036 | 7.593 | 7.598 | 7.768 | 0.000017 | 0.000000 | 0.999247 | 0.345252 | 0.470840 |

TABLE 15-continued

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 160 | NM_000956 | PTGER2 | 8.918 | 8.348 | 9.019 | 8.983 | 9.315 | 1.000000 | 0.000000 | 0.970366 | 0.070654 | 0.081972 |
| 161 | NM_001816 | CEACAM8 | 7.336 | 7.874 | 8.503 | 9.775 | 9.287 | 0.000000 | 0.001298 | 0.011921 | 0.098854 | 0.501991 |
| 162 | NM_016184 | CLEC4A | 8.210 | 8.289 | 9.043 | 8.708 | 9.051 | 0.000001 | 0.000030 | 0.153416 | 0.998827 | 0.141809 |
| 163 | NR_002217 | PMS2CL | 7.598 | 6.664 | 7.289 | 7.057 | 7.040 | 0.000000 | 0.000440 | 0.281314 | 0.146553 | 0.993528 |
| 164 | NM_001193374 | RETN | 7.747 | 7.886 | 8.097 | 8.248 | 8.835 | 0.000000 | 0.000109 | 0.767125 | 0.000526 | 0.022922 |
| 165 | NM_000922 | PDE3B | 8.142 | 8.242 | 7.627 | 7.734 | 7.730 | 0.000586 | 0.000010 | 0.567468 | 0.494918 | 0.999337 |
| 166 | NM_018837 | SULF2 | 9.831 | 9.704 | 9.064 | 9.248 | 8.696 | 0.000000 | 0.000000 | 0.721156 | 0.183689 | 0.059640 |
| 167 | NM_001145001 | NEK6 | 9.503 | 9.287 | 9.835 | 9.710 | 9.943 | 0.153083 | 0.000000 | 0.541334 | 0.546065 | 0.125355 |
| 168 | NM_022145 | CENPK | 7.073 | 6.142 | 6.664 | 6.040 | 6.012 | 0.000000 | 1.000000 | 0.003871 | 0.000401 | 0.988210 |
| 169 | NM_145725 | TRAF3 | 8.046 | 7.482 | 8.145 | 8.152 | 7.635 | 1.000000 | 0.000003 | 0.997488 | 0.011707 | 0.028412 |
| 170 | NM_003608 | GPR65 | 9.085 | 9.452 | 9.834 | 9.216 | 9.665 | 0.000000 | 1.000000 | 0.000115 | 0.360571 | 0.006354 |
| 171 | NR_046000 | IRF4 | 8.200 | 7.491 | 7.843 | 8.381 | 7.762 | 0.000105 | 0.000070 | 0.002770 | 0.825556 | 0.000501 |
| 172 | gi|42521648 | MACF1 | 6.473 | 6.545 | 7.013 | 7.187 | 7.377 | 0.000009 | 0.000481 | 0.609788 | 0.061186 | 0.553735 |
| 173 | NM_001144 | AMFR | 9.420 | 8.994 | 9.671 | 9.823 | 9.635 | 1.000000 | 0.000000 | 0.543847 | 0.954865 | 0.395265 |
| 174 | NM_000985 | RPL17 | 6.122 | 5.182 | 5.758 | 5.556 | 5.513 | 0.000000 | 0.000708 | 0.298432 | 0.096378 | 0.944801 |
| 175 | NM_003749 | IRS2 | 8.965 | 9.531 | 8.841 | 8.998 | 9.024 | 1.000000 | 0.000068 | 0.322209 | 0.133169 | 0.969809 |
| 176 | NM_002230 | JUP | 8.165 | 7.803 | 7.812 | 7.804 | 7.467 | 0.000000 | 1.000000 | 0.997835 | 0.006010 | 0.023849 |
| 177 | NM_013230 | CD24 | 5.563 | 5.793 | 6.173 | 7.205 | 7.139 | 0.000000 | 0.044339 | 0.008714 | 0.004161 | 0.979397 |
| 178 | NM_004481 | GALNT2 | 8.541 | 8.534 | 8.896 | 8.980 | 9.333 | 0.000001 | 0.000000 | 0.887956 | 0.017521 | 0.130219 |
| 179 | NM_007355 | HSP90AB1 | 9.881 | 8.635 | 9.085 | 9.720 | 9.186 | 0.000000 | 0.052850 | 0.015572 | 0.861439 | 0.050094 |
| 180 | NM_024656 | GLT25D1 | 9.757 | 9.336 | 9.948 | 9.861 | 10.201 | 1.000000 | 0.000001 | 0.826970 | 0.124352 | 0.061226 |
| 181 | NM_001001658 | OR9A2 | 4.207 | 4.662 | 4.825 | 4.991 | 5.108 | 0.000000 | 1.000000 | 0.671976 | 0.216358 | 0.816042 |
| 182 | NM_001178135 | HDHD1A | 8.039 | 7.927 | 8.296 | 8.300 | 8.508 | 0.156481 | 0.000026 | 0.999441 | 0.101404 | 0.187976 |
| 183 | NM_001141945 | ACTA2 | 6.977 | 6.906 | 7.430 | 7.434 | 7.417 | 0.000137 | 0.000000 | 0.999465 | 0.993242 | 0.991119 |
| 184 | NM_152282 | ACPL2 | 6.821 | 7.762 | 7.139 | 7.253 | 7.209 | 0.000000 | 0.038264 | 0.736975 | 0.857652 | 0.955277 |
| 185 | NM_001137550 | LRRFIP1 | 6.512 | 6.814 | 6.827 | 7.037 | 7.241 | 0.000015 | 1.000000 | 0.216163 | 0.000656 | 0.232230 |
| 186 | NM_001161352 | KCNMA1 | 5.664 | 6.042 | 6.492 | 6.317 | 7.025 | 0.000000 | 0.031350 | 0.804476 | 0.075606 | 0.033982 |
| 187 | gi|12584148 | OCR1 | 8.817 | 9.952 | 8.387 | 8.844 | 8.270 | 1.000000 | 0.000000 | 0.273663 | 0.890199 | 0.131897 |
| 188 | NM_000885 | ITGA4 | 8.779 | 7.932 | 8.394 | 7.981 | 7.906 | 0.000000 | 1.000000 | 0.064191 | 0.007047 | 0.909442 |
| 189 | NM_001412 | EIF1AX | 7.439 | 6.463 | 7.251 | 6.667 | 6.907 | 0.000022 | 0.033776 | 0.002586 | 0.056491 | 0.338619 |
| 190 | NM_176818 | SFRS9 | 9.739 | 9.666 | 9.715 | 10.226 | 10.128 | 1.000000 | 0.000618 | 0.000018 | 0.000064 | 0.627141 |
| 191 | NM_206831 | DPH3 | 6.211 | 6.602 | 6.923 | 6.606 | 6.842 | 0.000000 | 1.000000 | 0.052319 | 0.764333 | 0.189405 |
| 192 | NM_001031711 | ERGIC1 | 9.539 | 10.203 | 9.742 | 9.565 | 9.579 | 0.014810 | 0.000006 | 0.364984 | 0.320097 | 0.993728 |
| 193 | NM_007261 | CD300A | 9.890 | 9.479 | 10.058 | 10.054 | 10.025 | 1.000000 | 0.000000 | 0.999363 | 0.929522 | 0.957280 |
| 194 | NM_001085386 | NF-E4 | 7.348 | 8.202 | 7.715 | 8.545 | 7.934 | 0.000000 | 1.000000 | 0.002063 | 0.535657 | 0.030775 |
| 195 | NM_004897 | MINPP1 | 8.212 | 7.697 | 8.228 | 7.151 | 7.317 | 0.006705 | 1.000000 | 0.000005 | 0.000008 | 0.707929 |
| 196 | NM_003141 | TRIM21 | 8.072 | 8.151 | 8.840 | 8.371 | 8.271 | 0.002474 | 0.019577 | 0.006536 | 0.000092 | 0.782377 |
| 197 | NM_006969 | ZNF28 | 4.936 | 4.511 | 5.008 | 4.554 | 4.612 | 0.021118 | 0.027741 | 0.000020 | 0.000018 | 0.814925 |
| 198 | gi|21538810 | NPCDR1 | 5.404 | 5.022 | 4.784 | 5.166 | 4.817 | 0.000001 | 1.000000 | 0.000589 | 0.919120 | 0.001847 |
| 199 | gi|15530286 | NA | 9.276 | 9.224 | 8.804 | 8.909 | 8.390 | 0.001392 | 0.000629 | 0.821276 | 0.021614 | 0.011283 |
| 200 | gi|7021995 | NA | 7.607 | 8.002 | 6.917 | 7.075 | 6.999 | 0.480277 | 0.000000 | 0.721694 | 0.889525 | 0.926763 |
| 201 | NM_000201 | ICAM1 | 8.842 | 8.625 | 9.470 | 9.156 | 9.088 | 0.069361 | 0.000002 | 0.113961 | 0.015602 | 0.900519 |
| 202 | NM_005645 | TAF13 | 5.332 | 5.226 | 5.949 | 5.474 | 5.722 | 0.054434 | 0.000001 | 0.004467 | 0.457202 | 0.072895 |
| 203 | NM_000917 | P4HA1 | 6.365 | 6.096 | 6.773 | 6.664 | 6.873 | 1.000000 | 0.000000 | 0.752172 | 0.731181 | 0.358637 |
| 204 | NM_207445 | C15orf54 | 4.953 | 4.588 | 4.394 | 4.290 | 4.370 | 0.000000 | 0.891418 | 0.669439 | 0.972296 | 0.787051 |
| 205 | NM_002108 | HAL | 7.142 | 6.909 | 7.654 | 7.331 | 7.571 | 0.894890 | 0.000000 | 0.049449 | 0.758572 | 0.184215 |
| 206 | NM_015998 | KLHL5 | 9.003 | 9.971 | 9.113 | 9.407 | 9.630 | 0.009758 | 1.000000 | 0.315512 | 0.984513 | 0.248776 |
| 207 | NR_002612 | DLEU2 | 6.549 | 6.894 | 7.347 | 6.699 | 6.850 | 0.000171 | 1.000000 | 0.000019 | 0.000152 | 0.504529 |
| 208 | NM_015199 | ANKRD28 | 7.286 | 7.393 | 7.898 | 7.722 | 7.941 | 0.000001 | 0.046283 | 0.544926 | 0.951892 | 0.391621 |
| 209 | ENST00000375864 | LY6G5B | 9.037 | 8.992 | 8.780 | 8.654 | 8.383 | 0.014059 | 0.001656 | 0.642377 | 0.004351 | 0.135693 |
| 210 | ENST00000344062 | KIAA1257 | 6.868 | 7.365 | 6.882 | 6.874 | 6.689 | 1.000000 | 0.000000 | 0.997049 | 0.129430 | 0.242441 |
| 211 | NM_004528 | MGST3 | 9.104 | 8.519 | 9.273 | 9.098 | 9.003 | 1.000000 | 0.000001 | 0.377410 | 0.050613 | 0.751799 |
| 212 | NM_015187 | KIAA0746 | 8.174 | 7.591 | 8.170 | 8.747 | 8.502 | 1.000000 | 0.000002 | 0.015387 | 0.148674 | 0.453449 |
| 213 | NM_001540 | HSPB1 | 9.140 | 8.923 | 9.664 | 9.580 | 9.371 | 0.267148 | 0.000000 | 0.845749 | 0.072845 | 0.359260 |
| 214 | NM_005508 | CCR4 | 7.105 | 6.356 | 6.598 | 6.829 | 6.321 | 0.000000 | 1.000000 | 0.321399 | 0.120202 | 0.005850 |
| 215 | NM_001071 | TYMS | 6.084 | 5.695 | 6.186 | 6.854 | 6.291 | 1.000000 | 0.000000 | 0.003309 | 0.816061 | 0.015734 |
| 216 | ENST00000536831 | RRP12 | 8.946 | 8.381 | 8.821 | 8.752 | 8.721 | 0.000127 | 0.000063 | 0.794423 | 0.522969 | 0.952728 |
| 217 | NM_176816 | CCDC125 | 7.600 | 8.401 | 7.883 | 8.048 | 7.988 | 0.000029 | 0.000070 | 0.517640 | 0.700053 | 0.915690 |
| 218 | NM_003521 | HIST1H2BM | 10.104 | 9.242 | 10.213 | 10.837 | 10.261 | 1.000000 | 0.000000 | 0.055178 | 0.976895 | 0.083087 |
| 219 | NM_002612 | PDK4 | 7.445 | 8.411 | 8.080 | 8.035 | 8.318 | 0.000000 | 1.000000 | 0.982556 | 0.521742 | 0.501879 |
| 220 | NM_207627 | ABCG1 | 8.318 | 7.923 | 7.960 | 8.214 | 7.791 | 0.000000 | 1.000000 | 0.112606 | 0.270961 | 0.003184 |
| 221 | NM_000576 | IL1B | 9.070 | 9.172 | 10.021 | 9.550 | 9.930 | 0.000002 | 0.124840 | 0.077098 | 0.874756 | 0.185371 |
| 222 | NM_003246 | THBS1 | 8.599 | 9.860 | 8.993 | 9.423 | 9.387 | 0.000000 | 1.000000 | 0.179953 | 0.147689 | 0.987631 |
| 223 | NM_000419 | ITGA2B | 8.899 | 8.768 | 9.482 | 9.747 | 9.378 | 0.011285 | 0.000003 | 0.403390 | 0.825144 | 0.174155 |
| 224 | NM_005780 | LHFP | 6.216 | 6.391 | 6.523 | 6.665 | 6.754 | 0.000000 | 0.003992 | 0.475817 | 0.046096 | 0.625105 |
| 225 | NM_002287 | LAIR1 | 9.265 | 9.118 | 9.815 | 9.654 | 10.179 | 0.001517 | 0.000113 | 0.773401 | 0.179212 | 0.071167 |
| 226 | NM_003537 | HIST1H3B | 8.783 | 7.684 | 8.739 | 9.501 | 8.852 | 1.000000 | 0.000000 | 0.042709 | 0.908040 | 0.098544 |
| 227 | gi|29387167 | ZRANB1 | 8.205 | 9.041 | 8.641 | 8.455 | 8.619 | 0.000016 | 0.001723 | 0.476723 | 0.985358 | 0.563742 |
| 228 | ENST00000525158 | TIMM10 | 7.454 | 6.704 | 7.473 | 7.175 | 6.921 | 0.000333 | 0.000431 | 0.308861 | 0.006345 | 0.426642 |

TABLE 15-continued

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 229 | NM_207647 | FSD1L | 4.605 | 4.402 | 4.801 | 4.565 | 5.099 | 1.000000 | 1.000000 | 0.235142 | 0.050177 | 0.001077 |
| 230 | NM_021066 | HIST1H2AJ | 5.699 | 4.152 | 4.990 | 3.871 | 4.070 | 0.000128 | 1.000000 | 0.008735 | 0.013543 | 0.852098 |
| 231 | ENST00000362012 | PTGS1 | 8.883 | 8.605 | 9.293 | 9.429 | 9.247 | 1.000000 | 0.000001 | 0.723148 | 0.952752 | 0.562936 |
| 232 | gi|14250459 | NA | 6.389 | 5.970 | 6.875 | 5.976 | 6.059 | 1.000000 | 0.638753 | 0.000001 | 0.000000 | 0.869569 |
| 233 | NM_080678 | UBE2F | 7.698 | 7.618 | 8.235 | 8.225 | 8.425 | 0.009739 | 0.003879 | 0.998629 | 0.495878 | 0.558822 |
| 234 | NM_001104595 | FAM118A | 8.366 | 7.706 | 7.946 | 8.222 | 7.802 | 0.000086 | 0.879292 | 0.116376 | 0.451548 | 0.008324 |
| 235 | NM_003531 | HIST1H3C | 9.254 | 7.630 | 9.025 | 9.427 | 8.749 | 0.908521 | 0.000000 | 0.439119 | 0.594489 | 0.101186 |
| 236 | NM_003965 | CCRL2 | 6.401 | 6.488 | 6.982 | 6.754 | 7.040 | 0.000011 | 0.001007 | 0.386796 | 0.919567 | 0.226387 |
| 237 | NR_003094 | E2F6 | 4.235 | 3.673 | 4.143 | 3.579 | 3.647 | 0.002951 | 1.000000 | 0.000262 | 0.000208 | 0.874090 |
| 238 | NM_198275 | MPZL3 | 10.241 | 10.754 | 10.209 | 10.039 | 10.276 | 1.000000 | 0.000000 | 0.418422 | 0.832036 | 0.186944 |
| 239 | NM_080725 | SRXN1 | 9.497 | 9.560 | 9.732 | 9.815 | 10.069 | 0.084230 | 0.126068 | 0.777086 | 0.005812 | 0.101705 |
| 240 | NM_004357 | CD151 | 9.083 | 8.712 | 9.309 | 9.522 | 9.473 | 1.000000 | 0.000001 | 0.408420 | 0.488688 | 0.954477 |
| 241 | NM_003536 | HIST1H3H | 9.933 | 8.623 | 9.688 | 9.538 | 9.310 | 0.018867 | 0.000017 | 0.811822 | 0.177187 | 0.617435 |
| 242 | NM_031919 | FSD1L | 2.752 | 2.614 | 2.977 | 2.804 | 3.257 | 0.713444 | 0.000000 | 0.455516 | 0.068219 | 0.006227 |
| 243 | NM_001131065 | RFESD | 6.745 | 6.242 | 6.502 | 5.562 | 5.837 | 0.011176 | 1.000000 | 0.000486 | 0.005152 | 0.486482 |
| 244 | NM_012112 | TPX2 | 5.722 | 5.535 | 5.917 | 6.431 | 6.063 | 1.000000 | 0.000000 | 0.009609 | 0.587740 | 0.085624 |
| 245 | NM_006272 | S100B | 5.289 | 4.661 | 4.917 | 4.533 | 4.692 | 0.000031 | 1.000000 | 0.034824 | 0.206071 | 0.549376 |
| 246 | NM_032828 | ZNF587 | 8.514 | 8.816 | 8.783 | 8.381 | 8.101 | 1.000000 | 0.003242 | 0.018153 | 0.000001 | 0.136854 |
| 247 | NM_152501 | PYHIN1 | 8.390 | 8.040 | 7.744 | 7.890 | 7.473 | 0.000001 | 1.000000 | 0.732308 | 0.247163 | 0.086327 |
| 248 | NM_020775 | KIAA1324 | 9.383 | 9.433 | 8.708 | 9.010 | 8.061 | 0.053345 | 0.004214 | 0.630998 | 0.065841 | 0.013683 |
| 249 | NM_002483 | CEACAM6 | 5.249 | 5.373 | 5.959 | 6.957 | 6.219 | 0.000014 | 0.000574 | 0.023214 | 0.699643 | 0.121152 |
| 250 | NM_001130415 | APOLD1 | 7.318 | 6.858 | 7.205 | 7.363 | 7.253 | 0.906687 | 0.000002 | 0.263662 | 0.846643 | 0.520142 |
| 251 | NM_000134 | FABP2 | 4.244 | 4.518 | 4.396 | 4.549 | 4.826 | 0.000004 | 1.000000 | 0.578201 | 0.004767 | 0.174039 |
| 252 | NM_001080424 | KDM6B | 9.854 | 10.383 | 10.147 | 9.749 | 9.701 | 1.000000 | 0.000332 | 0.072707 | 0.013999 | 0.962410 |
| 253 | ENST00000390265 | IGK@ | 10.393 | 9.201 | 10.307 | 11.107 | 10.228 | 1.000000 | 0.000007 | 0.087003 | 0.967489 | 0.053514 |
| 254 | NM_006097 | MYL9 | 9.235 | 9.445 | 10.021 | 9.931 | 9.763 | 0.000001 | 0.017414 | 0.905037 | 0.337602 | 0.704183 |
| 255 | NM_021058 | HIST1H2BJ | 5.949 | 5.710 | 6.330 | 6.446 | 6.237 | 1.000000 | 0.000001 | 0.744162 | 0.779976 | 0.389990 |
| 256 | NM_138327 | TAAR1 | 5.009 | 5.081 | 5.282 | 5.490 | 5.498 | 0.000172 | 0.002470 | 0.224230 | 0.119996 | 0.998003 |
| 257 | NM_001828 | CLC | 10.866 | 9.692 | 9.618 | 9.860 | 9.296 | 0.000000 | 1.000000 | 0.790640 | 0.575586 | 0.284504 |
| 258 | NM_001199208 | CYP4F3 | 9.187 | 10.093 | 9.402 | 9.895 | 9.361 | 0.001998 | 0.007361 | 0.085034 | 0.976056 | 0.056129 |
| 259 | NM_024548 | CEP97 | 6.566 | 6.717 | 6.887 | 7.228 | 6.933 | 0.000121 | 1.000000 | 0.035314 | 0.917808 | 0.079681 |
| 260 | NM_138927 | SON | 8.449 | 7.921 | 8.330 | 7.930 | 8.146 | 0.000817 | 1.000000 | 0.003077 | 0.175728 | 0.168438 |
| 261 | NM_002198 | IRF1 | 10.490 | 10.067 | 10.764 | 10.511 | 10.387 | 1.000000 | 0.000000 | 0.154240 | 0.005202 | 0.633454 |
| 262 | NM_182914 | SYNE2 | 7.764 | 8.208 | 7.453 | 7.752 | 7.322 | 1.000000 | 0.000000 | 0.184100 | 0.642671 | 0.032921 |
| 263 | NM_000902 | MME | 9.625 | 10.744 | 9.401 | 10.054 | 8.937 | 1.000000 | 0.000000 | 0.270540 | 0.411394 | 0.024808 |
| 264 | NM_024552 | LASS4 | 8.222 | 7.808 | 7.961 | 8.050 | 8.099 | 0.000006 | 0.005941 | 0.629532 | 0.232135 | 0.868727 |
| 265 | NM_001925 | DEFA4 | 7.421 | 7.383 | 8.289 | 9.454 | 8.658 | 0.001307 | 0.000125 | 0.042189 | 0.642870 | 0.220174 |
| 266 | NM_024913 | C7orf58 | 7.727 | 6.800 | 7.706 | 7.617 | 7.307 | 0.136406 | 0.003979 | 0.899378 | 0.062794 | 0.276354 |
| 267 | ENST00000549649 | DYNLL1 | 7.250 | 7.328 | 8.200 | 7.946 | 7.948 | 0.089409 | 0.021345 | 0.534724 | 0.441022 | 0.999958 |
| 268 | gi|38532374 | NA | 5.269 | 5.274 | 4.828 | 4.979 | 4.814 | 0.188367 | 0.002418 | 0.307760 | 0.984538 | 0.242328 |
| 269 | NM_000250 | MPO | 7.605 | 7.565 | 8.053 | 8.694 | 8.262 | 0.003309 | 0.000013 | 0.050366 | 0.644219 | 0.248933 |
| 270 | NM_001874 | CPM | 5.874 | 6.569 | 5.926 | 5.965 | 6.153 | 0.263893 | 0.011698 | 0.965100 | 0.195596 | 0.424691 |
| 271 | NM_173485 | TSHZ2 | 7.382 | 6.972 | 6.846 | 7.429 | 6.929 | 0.004682 | 1.000000 | 0.000051 | 0.739871 | 0.000534 |
| 272 | NR_038064 | PLIN2 | 8.210 | 8.534 | 8.470 | 8.589 | 8.747 | 0.000009 | 1.000000 | 0.661459 | 0.056585 | 0.485502 |
| 273 | NM_024556 | FAM118B | 7.287 | 7.256 | 7.846 | 7.892 | 7.670 | 0.002863 | 0.002878 | 0.963051 | 0.489433 | 0.425727 |
| 274 | NM_001199873 | B4GALT3 | 9.539 | 8.790 | 9.278 | 9.265 | 9.060 | 0.000004 | 0.006105 | 0.996920 | 0.309691 | 0.456795 |
| 275 | NM_006989 | RASA4 | 8.298 | 8.139 | 7.796 | 8.031 | 7.741 | 0.000237 | 0.794307 | 0.149393 | 0.868630 | 0.057952 |
| 276 | NM_001257971 | CTSL1 | 6.074 | 5.925 | 6.577 | 6.106 | 6.472 | 0.556174 | 0.000261 | 0.038526 | 0.798163 | 0.134791 |
| 277 | NM_000270 | NP | 9.487 | 9.103 | 9.780 | 10.001 | 9.866 | 1.000000 | 0.000006 | 0.557046 | 0.887942 | 0.802758 |
| 278 | NM_001130059 | ATF7 | 5.212 | 5.212 | 5.253 | 5.605 | 5.372 | 1.000000 | 0.438013 | 0.000033 | 0.171523 | 0.007397 |
| 279 | NM_003118 | SPARC | 9.083 | 9.207 | 9.737 | 9.964 | 9.620 | 0.000424 | 0.113905 | 0.627252 | 0.847118 | 0.345974 |
| 280 | NM_153021 | PLB1 | 6.867 | 7.077 | 7.318 | 7.615 | 7.373 | 0.001516 | 1.000000 | 0.250568 | 0.355397 | 0.913465 |
| 281 | NM_001170330 | C4orf3 | 7.478 | 7.240 | 7.324 | 7.402 | 7.760 | 1.000000 | 0.245460 | 0.750146 | 0.000037 | 0.004098 |
| 282 | NM_002692 | POLE2 | 7.205 | 6.613 | 7.184 | 6.047 | 6.359 | 0.156285 | 1.000000 | 0.000226 | 0.002251 | 0.494438 |
| 283 | NM_001192 | TNFRSF17 | 4.474 | 4.005 | 4.587 | 5.008 | 4.554 | 1.000000 | 0.000000 | 0.122703 | 0.982429 | 0.088234 |
| 284 | NM_145032 | FBXL13 | 6.474 | 6.987 | 6.791 | 7.387 | 6.914 | 0.000011 | 1.000000 | 0.027018 | 0.806772 | 0.098170 |
| 285 | NM_019091 | PLEKHA3 | 7.058 | 6.910 | 7.281 | 6.689 | 6.825 | 1.000000 | 1.000000 | 0.000001 | 0.000011 | 0.409707 |
| 286 | NM_024956 | TMEM62 | 7.599 | 7.189 | 7.875 | 7.664 | 7.625 | 1.000000 | 0.002245 | 0.254101 | 0.080350 | 0.953292 |
| 287 | NM_052960 | RBP7 | 7.270 | 7.808 | 7.218 | 7.267 | 7.088 | 1.000000 | 0.000005 | 0.953122 | 0.639431 | 0.530295 |
| 288 | NM_024613 | PLEKHF2 | 7.432 | 7.660 | 8.044 | 7.255 | 7.671 | 0.789194 | 1.000000 | 0.000012 | 0.023331 | 0.029137 |
| 289 | NM_002923 | RGS2 | 11.584 | 12.239 | 11.737 | 11.649 | 11.703 | 0.162049 | 0.000001 | 0.862749 | 0.969968 | 0.947024 |
| 290 | NM_004691 | ATP6V0D1 | 11.562 | 11.584 | 11.951 | 11.656 | 11.692 | 0.064067 | 1.000000 | 0.011327 | 0.010003 | 0.932404 |
| 291 | NM_144563 | RPIA | 9.444 | 9.221 | 8.913 | 8.388 | 8.784 | 0.001733 | 0.264252 | 0.097918 | 0.824211 | 0.261542 |
| 292 | NM_020397 | CAMK1D | 9.001 | 9.118 | 8.603 | 8.572 | 8.527 | 0.163494 | 0.002054 | 0.980872 | 0.858346 | 0.960862 |
| 293 | NM_016232 | IL1RL1 | 5.573 | 6.273 | 5.757 | 6.219 | 6.253 | 0.000028 | 1.000000 | 0.065034 | 0.016357 | 0.984841 |
| 294 | NM_138460 | CMTM5 | 7.473 | 7.266 | 7.853 | 7.851 | 7.716 | 1.000000 | 0.000000 | 0.999922 | 0.538365 | 0.635314 |
| 295 | NM_004847 | AIF1 | 8.167 | 8.310 | 8.735 | 8.045 | 8.239 | 1.000000 | 1.000000 | 0.000120 | 0.001571 | 0.448676 |
| 296 | NM_001928 | CFD | 10.389 | 9.779 | 9.631 | 9.496 | 9.702 | 0.000005 | 1.000000 | 0.830277 | 0.934225 | 0.650508 |

TABLE 15-continued

Healthy versus inSIRS versus ipSIRS versus Mild versus Severe versus Shock p Value and Area Under Curve (AUC)

| SEQ ID Number | Database ID | Gene Name | HC Mean | inSIRS Mean | Mild Mean | Severe Mean | Shock Mean | pval HC vs Other | pval inSIRS vs Sepsis | pval Severe vs Mild | pval Shock vs Mild | pval Shock vs Severe |
|---|---|---|---|---|---|---|---|---|---|---|---|---|
| 297 | NM_144765 | MPZL2 | 7.015 | 7.320 | 6.845 | 6.660 | 6.644 | 1.000000 | 0.000023 | 0.471520 | 0.309485 | 0.994504 |
| 298 | gi|27884043 | LOC100128751 | 8.552 | 8.877 | 8.333 | 8.552 | 8.283 | 1.000000 | 0.001039 | 0.155603 | 0.877005 | 0.063053 |
| 299 | NM_144646 | IGJ | 8.646 | 7.900 | 8.962 | 10.005 | 9.230 | 1.000000 | 0.000100 | 0.078833 | 0.793766 | 0.239952 |
| 300 | NM_139286 | CDC26 | 7.968 | 7.634 | 8.113 | 7.886 | 8.065 | 1.000000 | 0.000005 | 0.095936 | 0.867921 | 0.226701 |
| 301 | NM_006241 | PPP1R2 | 7.446 | 7.738 | 7.546 | 7.286 | 7.113 | 1.000000 | 0.001735 | 0.115620 | 0.000618 | 0.379268 |
| 302 | NM_000564 | IL5RA | 6.871 | 6.298 | 6.092 | 6.455 | 5.954 | 0.000000 | 1.000000 | 0.186587 | 0.721925 | 0.044203 |
| 303 | NM_001113738 | ARL17P1 | 8.846 | 8.829 | 8.802 | 8.293 | 7.810 | 1.000000 | 1.000000 | 0.160174 | 0.000219 | 0.191966 |
| 304 | NR_033759 | ATP5L | 7.242 | 7.337 | 7.379 | 6.824 | 6.772 | 1.000000 | 0.748516 | 0.000612 | 0.000014 | 0.929559 |
| 305 | NM_176885 | TAS2R31 | 6.228 | 5.589 | 5.847 | 6.020 | 6.056 | 0.010741 | 0.032666 | 0.488873 | 0.253434 | 0.969967 |
| 306 | NM_001024599 | HIST2H2BF | 8.854 | 9.615 | 9.386 | 9.211 | 8.840 | 0.014281 | 0.064555 | 0.679691 | 0.009289 | 0.184703 |
| 307 | NM_001743 | CALM2 | 8.475 | 9.041 | 9.003 | 8.357 | 8.540 | 1.000000 | 1.000000 | 0.000906 | 0.007024 | 0.542344 |
| 308 | NM_019073 | SPATA6 | 6.797 | 7.301 | 7.095 | 6.806 | 7.221 | 0.000572 | 1.000000 | 0.238268 | 0.690136 | 0.055163 |
| 309 | ENST00000390285 | IGLV6-57 | 5.779 | 5.379 | 6.029 | 6.575 | 6.026 | 1.000000 | 0.000002 | 0.138073 | 0.999915 | 0.135136 |
| 310 | NM_020362 | C1orf128 | 9.258 | 9.026 | 8.605 | 8.315 | 8.523 | 0.000049 | 0.377958 | 0.469588 | 0.921733 | 0.676477 |
| 311 | NM_181623 | KRTAP15-1 | 6.250 | 6.690 | 6.548 | 6.617 | 6.488 | 0.001154 | 1.000000 | 0.779960 | 0.773039 | 0.418346 |
| 312 | NM_006417 | IFI44 | 6.559 | 6.924 | 8.107 | 6.674 | 6.408 | 1.000000 | 1.000000 | 0.007884 | 0.000183 | 0.836520 |
| 313 | NM_001178126 | IGL@ | 7.052 | 6.606 | 7.027 | 7.343 | 7.023 | 1.000000 | 0.000000 | 0.162844 | 0.999656 | 0.156176 |
| 314 | gi|21707823 | NA | 4.903 | 5.476 | 4.955 | 4.639 | 4.576 | 1.000000 | 0.188292 | 0.144998 | 0.026471 | 0.921677 |
| 315 | NM_003001 | SDHC | 7.530 | 6.874 | 7.879 | 7.593 | 7.764 | 1.000000 | 0.000026 | 0.453417 | 0.841420 | 0.752519 |
| 316 | NM_152995 | NFXL1 | 7.326 | 6.876 | 7.694 | 7.644 | 7.620 | 1.000000 | 0.000002 | 0.977232 | 0.934372 | 0.994545 |
| 317 | NM_000170 | GLDC | 5.599 | 5.395 | 5.679 | 5.770 | 5.666 | 1.000000 | 0.000010 | 0.537664 | 0.982363 | 0.443725 |
| 318 | NM_001199743 | DCTN5 | 8.646 | 8.336 | 8.737 | 8.794 | 8.672 | 1.000000 | 0.000532 | 0.865968 | 0.779044 | 0.519467 |
| 319 | NM_014736 | KIAA0101 | 4.443 | 3.951 | 4.537 | 4.749 | 4.419 | 1.000000 | 0.000000 | 0.416052 | 0.694594 | 0.124264 |

Example 6

Ratios of IRS Biomarkersmarkers Between Healthy, INSIRS, Mild Sepsis, Severe Sepsis and Septic Shock Examples of the use of 2-gene ratios as a more informative predictor of clinical condition than either of the two component genes are presented in Tables 16, 17, 18, 19, 20 and 21. These tables show instances of the prediction of Healthy and inSIRS (Table 16), Healthy vs. ipSIRS (Table 17), inSIRS and ipSIRS (Table 18), Mild Sepsis vs.Vs Severe Sepsis (Table 19), Mild Sepsis Vs Septic Shock (Table 20), and Severe Sepsis vs.Vs Septic Shock (Table 21) using 2 genes and their ratios. Columns from left to right are: name of the first component gene (Gene 1 Name), the corresponding Area Under Curve for this gene (Gene 1 AUC), the second component gene (Gene 2 Name), the corresponding AUC for this gene (Gene 2 AUC), the AUC for this ratio (Ratio AUC), the statistical significance using Delong's method (DeLong E R, DeLong D M, Clarke-Pearson D L: Comparing the Areas under Two or More Correlated Receiver Operating Characteristic Curves: A Non parametric Approach. *Biometrics* 1988, 44:837-845) that the ratio is a better predictor than Gene 1 (Ratio Signif to Gene 1), the statistical significance using Delong's method that the ratio is a better predictor than Genet (Ratio Signif to Gene 2). These tables show results for which the ratio AUC is shown to be superior to both of the component genes, and the improvement statistically significant over both genes. Examples of less significant ratios, or cases where the ratio is statistically superior to only one of the component genes are not listed in these tables. Such ratios can also be used in clinical trials in a similar fashion to that described in Example 5.

Lengthy table referenced here

US10167511-20190101-T00001

Please refer to the end of the specification for access instructions.

Lengthy table referenced here

US10167511-20190101-T00002

Please refer to the end of the specification for access instructions.

Lengthy table referenced here

US10167511-20190101-T00003

Please refer to the end of the specification for access instructions.

Lengthy table referenced here

US10167511-20190101-T00004

Please refer to the end of the specification for access instructions.

Lengthy table referenced here

US10167511-20190101-T00005

Please refer to the end of the specification for access instructions.

Lengthy table referenced here

US10167511-20190101-T00006

Please refer to the end of the specification for access instructions.

Throughout this specification and claims which follow, unless the context requires otherwise, the word "comprise", and variations such as "comprises" or "comprising", will be understood to imply the inclusion of a stated integer or group of integers or steps but not the exclusion of any other integer or group of integers.

Persons skilled in the art will appreciate that numerous variations and modifications will become apparent. All such variations and modifications, which become apparent to persons skilled in the art, should be considered to fall within the spirit and scope that the invention broadly appearing before described.

LENGTHY TABLES

The patent contains a lengthy table section. A copy of the table is available in electronic form from the USPTO web site (http://seqdata.uspto.gov/?pageRequest=docDetail&DocID=US10167511B2). An electronic copy of the table will also be available from the USPTO upon request and payment of the fee set forth in 37 CFR 1.19(b)(3).

SEQUENCE LISTING (619 sequences)

SEQ ID NO: 1 - DNA, 4277 bp, Homo sapiens
  source (1)..(4277): /organism="Homo sapiens" /note="TLR5" /mol_type="unassigned DNA"
ggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcccttagaggtttccagtctccattgattttctttcagatccaataataccgttctgtcctgctgtgttgattatggaatgtatcctaatcatgggaagggcaccttgggagaagttgcagatggctgacgtgctttctctagcattcagctaaaaaatgggatggtccatgattctgcgttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtgactgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttccttcgttgccctaatgaccacaagagaacacatacactgaaggcctcctggggggcagttgcaatttcactgaagttgtatttttttatcttaaatgaaatctatgtgtattttcaaaaaaaaaa

SEQ ID NO: 2 - DNA, 2364 bp, Homo sapiens
  source (1)..(2364): /organism="Homo sapiens" /note="CD177" /mol_type="unassigned DNA"
ctgctgaaaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacctgggaggggaagatgcactgagacgtatgaggcttccagcctagcagccagggccctagcacaaacaggaggctcgccccatctgagcaactgcaggagaggttagtacagtcatgcattgcttaacgacagggacgtgtcgttagaaatgtgtcgttaggtgattttatgaccataggaacattgtagcgtgcacttacaccaacccagatggtacagcccaatacacacccaggatggacgctagagtcgactgctcctaggctacaagcctgcagtgcatgttatggtgtgaatactgcaggcaatcttaacaccacggcaagtatttgtgcatctacacacatctaaacatagaaaaggtacagcataaatacactattgtcatctcagcagaccaccgttctatacgcaattcgtcgctgacccaaacgttgctatgtagcatctgcgtatcgtgggataattgacatgagggcttgagagaactccagaaaaaaatgggttagcattttcccagagctgttatcattgggtctctcttaccaccata

SEQ ID NO: 3 - DNA, 2368 bp, Homo sapiens
  source (1)..(2368): /organism="Homo sapiens" /mol_type="unassigned DNA"
caaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctctttttgttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttagagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaa

SEQ ID NO: 4 - DNA, 4348 bp, Homo sapiens
  source (1)..(4348): /organism="Homo sapiens" /note="NM_016021" /mol_type="unassigned DNA"
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataaaaaaa

SEQ ID NO: 5 - DNA, 1246 bp, Homo sapiens
  source (1)..(1246): /organism="Homo sapiens" /note="NM_018285" /mol_type="unassigned DNA"
ccctggccaatgggaagtgagggcgtgactttaagtctttctttcattggcccagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttttaaaaaaaaa

SEQ ID NO: 6 - DNA, 735 bp, Homo sapiens
  source (1)..(735): /organism="Homo sapiens" /note="NM_002934" /mol_type="unassigned DNA"
gctgcccctgaaccccagaacaaccagctggatcagttctcacaggagctacagcgcggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 7 - DNA, 1946 bp, Homo sapiens
  source (1)..(1946): /organism="Homo sapiens" /note="NM_080387" /mol_type="unassigned DNA"
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtggaccagacgccatttaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacattaattgcaaagggcagtcacatccaactttaataaaatatggtggtctttcttaaaaaaaaaaaaaa

SEQ ID NO: 8 - DNA, 1965 bp, Homo sapiens
  source (1)..(1965): /organism="Homo sapiens" /note="NM_004054" /mol_type="unassigned DNA"
actgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtaaaaaaaaaa

SEQ ID NO: 9 - DNA, 3999 bp, Homo sapiens
  source (1)..(3999): /organism="Homo sapiens" /note="NM_001145772" /mol_type="unassigned DNA"
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactggaaaaaaaaaa

SEQ ID NO: 10 - DNA, 1499 bp, Homo sapiens
  source (1)..(1499): /organism="Homo sapiens" /note="NM_001244438" /mol_type="unassigned DNA"
ggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagattaaaa

SEQ ID NO: 11 - DNA, 2198 bp, Homo sapiens
  source (1)..(2198): /organism="Homo sapiens" /note="NR_045213" /mol_type="unassigned DNA"
aatatcttgcatgttacagatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccgtgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgttgccagtcctaggcccctgccctgtaggaaggcagaatgtaactgttctttttgtttaacgattaagtccaaatctccaagtgcggcactgcaaagagacgcttcaagtggggagaagcggcgatatcatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaaaaaaaaaaaaa

SEQ ID NO: 12 - DNA, 3496 bp, Homo sapiens
  source (1)..(3496): /organism="Homo sapiens" /note="NM_145018" /mol_type="unassigned DNA"
gccaaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagatt

SEQ ID NO: 13 - DNA, 2107 bp, Homo sapiens
  source (1)..(2107): /organism="Homo sapiens" /note="NM_018099" /mol_type="unassigned DNA"
cacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccaaaaaaaaaaaaa

SEQ ID NO: 14 - DNA, 751 bp, Homo sapiens
  source (1)..(751): /organism="Homo sapiens" /note="NM_006433" /mol_type="unassigned DNA"
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttaaaaaaaa

SEQ ID NO: 15 - DNA, 3275 bp, Homo sapiens
  source (1)..(3275): /organism="Homo sapiens" /note="NM_004482" /mol_type="unassigned DNA"
gcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaaaaaaaaaa

SEQ ID NO: 16 - DNA, 1905 bp, Homo sapiens
  source (1)..(1905): /organism="Homo sapiens" /note="NM_002544" /mol_type="unassigned DNA"
ataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcaaaaaaaaaaa

SEQ ID NO: 17 - DNA, 3322 bp, Homo sapiens
  source (1)..(3322): /organism="Homo sapiens" /note="NM_207113" /mol_type="unassigned DNA"
aggggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaaaaaaaaaaaaa

SEQ ID NO: 18 - DNA, 2592 bp, Homo sapiens
  source (1)..(2592): /organism="Homo sapiens" /note="NM_203281" /mol_type="unassigned DNA"
aataaacgtgttgggggcactgagtaatgtagccatttctgacccggcagccaggaaaatgtgaaacaatttgcttctggaaacaggacagccggggccgtgttcctgcaacagcagaccaagcaccgcggcggacccaggcaagcacggaacaagctgagacggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtggaaaaaaaaaa

SEQ ID NO: 19 - DNA, 3198 bp, Homo sapiens
  source (1)..(3198): /organism="Homo sapiens" /note="NM_004099" /mol_type="unassigned DNA"
acctcgattgggggcggggcggcaatctgggtcttgtgcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagtacattagatcctccggttctg

SEQ ID NO: 20 - DNA, 4772 bp, Homo sapiens
  source (1)..(4772): /organism="Homo sapiens" /note="NM_153046" /mol_type="unassigned DNA"
ttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagccaaaggagctcagaagtagagtatattaacaaatacagacagctcgaagcacaagagcttgatgtgtgtcgcagtgtccaaccaaccagtgggccaggtccaaggccatctttggctaaattaagcagtgtgacgtgcatcccagggacaacttataaatatcctgatttgcctataagtcgatacaaggaagaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtagggctagagaaaatagcaacagaggacaccaggctaatttatatgacaactggagtcctgcttcagaaaatagttagtgccaagagtttgatggaattcacacatatcatcattgatgaagtacacgaacgaacagaagaaatggatttcctgctattggtagtccgcaaactcttaagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggcagaacttcacgggccttttaacccttatgaactaaagtgccatagtttgaccagaatatccaaattcaggtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaaaaaaaaaaa

SEQ ID NO: 21 - DNA, 2759 bp, Homo sapiens
  source (1)..(2759): /organism="Homo sapiens" /note="NM_032045" /mol_type="unassigned DNA"
cgcgctgccccctttaccccgggccgcgccccggggccccgcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgcaattcaggactcggaagtgacatcactcatctggtctcaggggcagcccagaagtatctgactgtagacacaactaggctccgtgggcatatctgggtggcaatttcagagggcagaggggacaccttcattgcctctcctcgcacagaaatggtgggctctctctggcccagcgtggtggttcatgcctgtaataccagcgttttgggaggctgagatgggaggattgcttgagcccaggaggtcgaggctgcagtgagctatgatcacaccaccacactccagcctgagcagcagagcgggacctcgtctctaagaatagaaagaaagaaagagaaacggtgtcctccgcacagccggtcagaactgtgtgactcacttgaggcaggaccgagagtgacatccagttgcacctttctcacctactttgggacctttgggggtgagttcccctttgtcctctcgtggaaacagcacacagcaagcaaccacaaaaccagagcggaaggagggacttcccaccggcatccggccccagtgccatgttttatcatctggaacggttgtgaagctttgtgtgacttgctcaggatcagcagtcaccatggtctaatcccaagagggactcgtcacccagagacctcaaaaggccccaggcctactgtggttttttctgagaggctcccagaaccaagtggcacgttggtttcctgtgcgtctgtgtctttgtgcctgtatctcgctgggggacttcacaggaagcaggatttgggcattcctgaagctcccagctggacaccactcctgagcgccacatcccatgatcacttcaaccacaggcctttgactttgccacatggcaaggcacccagcagaagatgaggatgacgggtgatgctagatggatgtgtacctggtggatggcccacgcacgaagactcaagaccctcaggactggccatataatctgcaaggtccagtatgaaataagaataagcagcccacacaactgggcatagtggttcatgcctgtaatcccagcactttgggaggctgaggagggtggatcacttgaggccaggaattcgagaccagcctggccaacatggcgaaaacccatctctactaaaaatacaaaaattagttgggcatggtggcacacacctgtaatcccagctactcggaggctgaggcacaagaattgcttgaacctgggaggcggaggttgcagtgagctgagataacgccactgcactccagtgtaggcaacagagtgagaccctgtctc

SEQ ID NO: 22 - DNA, 3095 bp, Homo sapiens
  source (1)..(3095): /organism="Homo sapiens" /note="NM_005449" /mol_type="unassigned DNA"
agcctgagaatagttagcaaacaagggaggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaatactgacattaattaaatagagttgtaataaaaaaaaaaaa

SEQ ID NO: 23 - DNA, 2158 bp, Homo sapiens
  source (1)..(2158): /organism="Homo sapiens" /note="NM_014358" /mol_type="unassigned DNA"
atattctacatctatcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcactaccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtttccagttctaccgatgttcccacaaaagacataattttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 24 - DNA, 3522 bp, Homo sapiens
  source (1)..(3522): /organism="Homo sapiens" /note="NM_003855" /mol_type="unassigned DNA"
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 25 - DNA, 4387 bp, Homo sapiens
  source (1)..(4387): /organism="Homo sapiens" /note="NM_018367" /mol_type="unassigned DNA"
gggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctatttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctacagcaaattatattttagaaaatactttgtgaggccgggcatggtggcagagcgagactccgtctcaaaaaaaaaaaaaaaaaaaaaaaagaaaagaaaagaaaatataaggatgtaaaagaagcaatttgcttgcacatctgaatatccttcttgtgcctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttggacttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtgg

SEQ ID NO: 26 - DNA, 3450 bp, Homo sapiens
  source (1)..(3450): /organism="Homo sapiens" /note="NM_006459" /mol_type="unassigned DNA"
gatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgaaaaaaaaaaaa

SEQ ID NO: 27 - DNA, 6475 bp, Homo sapiens
  source (1)..(6475): /organism="Homo sapiens" /note="NM_004612" /mol_type="unassigned DNA"
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 28 - DNA, 3951 bp, Homo sapiens
  source (1)..(3951): /organism="Homo sapiens" /note="NM_001145775" /mol_type="unassigned DNA"
agaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttccaaaaaaaaaaa

SEQ ID NO: 29 - DNA, 1519 bp, Homo sapiens
  source (1)..(1519): /organism="Homo sapiens" /note="NM_020370" /mol_type="unassigned DNA"
ctgcttgaagcctaactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgcttttaaaaaaaaaaaa

SEQ ID NO: 30 - DNA, 1686 bp, Homo sapiens
  source (1)..(1686): /organism="Homo sapiens" /note="NM_182597" /mol_type="unassigned DNA"
agttaccaactaaatcagggcatggtgtttttttgttgttttctttttaaagcatagttttagtaatatatttactaaaaaccttagacattatgaaaaaagtcaggatttggaatcttacactgcttggctaaattgacacaatatagaccaacagtttcatcctggggcttatgggtctcataggagcacccgtatgctgaagaaaggcaaagagagaactacagaatttgtagaaaagttttgttgtagttgcttctgaacaattagtttttgtttgtttgttttgttttgttttgtttttctggtaacctagcagtcaaagctcacatttttggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctagcagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagcaaaaaaaaaaa

SEQ ID NO: 31 - DNA, 5148 bp, Homo sapiens
  source (1)..(5148): /organism="Homo sapiens" /note="NM_153021" /mol_type="unassigned DNA"
ggagcagctcttccagaggcccgagtcacctggagcattctggcatggggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgtcgcagcctggcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacatgtcattttgggaaaaggaataaaaaatgattgggacacaaa

SEQ ID NO: 32 - DNA, 4050 bp, Homo sapiens
  source (1)..(4050): /organism="Homo sapiens" /note="NM_013352" /mol_type="unassigned DNA"
agtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaaaaaaaaaaaaa

SEQ ID NO: 33 - DNA, 2951 bp, Homo sapiens
  source (1)..(2951): /organism="Homo sapiens" /note="NM_000953" /mol_type="unassigned DNA"
cgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccatgattaaaaaaaaaaagacaacttacaatttaaatccttaaaagttacctcccataacaaaagcatgtatatgtattttcaaaagtatttgatatcttaacaatgtgttaccattctatagtcatgaaccccttcagtgcattttcatttttttattaacagcaactaaaattttatatattgtaaccagtgttaaaagtcttaaaaaacaatggtattaattgtccctacatttgtgcttggtggccctattttttttttttagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcgtttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagtaaaaaaaaaa

SEQ ID NO: 34 - DNA, 2251 bp, Homo sapiens
  source (1)..(2251): /organism="Homo sapiens" /note="NM_001744" /mol_type="unassigned DNA"
agtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaaaaaaaaaaa

SEQ ID NO: 35 - DNA, 7551 bp, Homo sapiens
  source (1)..(7551): /organism="Homo sapiens" /note="NM_015268" /mol_type="unassigned DNA"
gagccggcggcgggaggagctagggctggagcctctccagcctcccgcgaaggtttgagcacaaaatgaacataattagggaaaataaggatctggcatgtttctacacaacaaaacattcatggagggggaagtataagcgtgtcttttcagttggaactcatgcgattactacatataatcccaataccttagaagtaacaaatcagtggccttatggagacatttgcagcatcagccctgttggaaaaggacaaggaacggagttcaacctcacatttcgtaaaggcagtggaaaaaagtcagaaactttaaaattttctacagagcacagaacagaacttcttacagaagcattgagatttagaactgatttttcagagggaaaaatcacaggaaggagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattgcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggagcctgttaaaagagttctagcacttacagaaacatgtttagtagaacgtgatccggcaacctataatattgcaacattgaagcctttaggagaagtatttgcgttggtctgtgactcagaaaatccacaactttttaccattgaatttataaaagggcaagtacggaaatattcttcaacagagagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcctccaaatggcaactttgcagatgctgtattcaggttcaatgctaatatttcatacagtggagtcctacatgcagtaacacaagatggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtttcgcgagcgtctaggggtgaaggtagtaaaagcactcaaaagaagcaacaacggaataatccatgcagcagttgatatgctttgtgcccttatgtgtcccatgcatgatgactatgacttaagacaagaacagttgaacaaagcttctcttctctcgtcaaagaagtttctggaaaacttactggagaaatttaattcccatgtggatcatgggactggtgccctagttattagttcgctcttggacttccttacctttgccctctgtgctccatatagtgagacaactgaagggcagcagtttgatatgctcttggagatggtagcatccaatggaagaaccctttttaaactttttcagcatccttccatggcaataataaaaggagctgggttggttatgaaggcaataatagaggaaggtgataaagaaattgctacaaaaatgcaggagcttgccctaagtgaaggtgccttacctcgacacttgcatactgcgatgtttacaataagctcagatcaaaggatgcttacaaatagacagctaagtagacatttagtgggactctggacagctgataatgcaactgcaacaaacttgttgaaacgcattttgccgccaggcttgctggcatacttggaaagctcagatctcgtacctgagaaggatgctgatcggatgcatgttagagacaatgtgaaaatagcaatggatcagtatggaaaatttaataaagttccagagtggcaaagactagctggaaaagctgctaaagaagttgaaaaatttgccaaagaaaaagtggatcttgtattgatgcactggagggataggatgggcattgctcaaaaagagaatataaatcagaagccagtggttcttcgaaagagaagacaaagaataaaaatagaagcaaattgggatctcttctattataggtttggtcaagaccatgccaggtcaaaccttatttggaatttcaaaacacgagaagaactgaaagatactcttgaatctgaaatgagagcatttaatattgacagagaacttggaagtgcaaatgtgatctcctggaaccaccatgagtttgaggttaaatatgagtgcctggcagaggaaattaaaataggagactattacctgagattactattggaggaagatgagaatgaagaaagtggatcaattaagagatcgtatgaatttttcaatgagctttatcatcgcttcttgctcaccccaaaagtaaacatgaagtgtttatgtttacaagcccttgctattgtttatggcagatgtcacgaagaaataggaccttttacagataccagatatatcattggaatgttagagaggtgcacagataaacttgaacgagataggttgattctcttccttaacaagttgatccttaataagaaaaatgttaaggatctcatggattcaaatggaataagaatccttgtggacttgcttacccttgcacatctccatgtaagccgagctacagtaccactgcaaagcaatgtaattgaagctgctccagatatgaaaagagagagtgaaaaggaatggtattttggcaacgcagacaaagaaaggagtggcccgtatggatttcatgagatgcaagaattgtggaccaaaggaatgttaaatgcaaaaaccagatgctgggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgtgctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgagaaaaa

SEQ ID NO: 36 - DNA, 1433 bp, Homo sapiens
  source (1)..(1433): /organism="Homo sapiens" /note="NM_007115" /mol_type="unassigned DNA"
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaaaaaaaaa

SEQ ID NO: 37 - DNA, 2218 bp, Homo sapiens
  source (1)..(2218): /organism="Homo sapiens" /note="NM_199135" /mol_type="unassigned DNA"
cattcatcccaggcttccagctcagcccgccccaggccaggtgatcggccgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagaatttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacactacatcgtttattttctattacatctcattcttccctttctaaatggaactttttaaaacctacgttattttccctcaaacaatttattttcacaattcatatttattatagatagcagaagtaatccattttaatatggcctttaaaaattccaaatatttgaggttgaaaatgtcctgg

SEQ ID NO: 38 - DNA, 2347 bp, Homo sapiens
  source (1)..(2347): /organism="Homo sapiens" /note="NM_004994" /mol_type="unassigned DNA"
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaa

SEQ ID NO: 39 - DNA, 3167 bp, Homo sapiens
  source (1)..(3167): /organism="Homo sapiens" /note="NM_000637" /mol_type="unassigned DNA"
tcctcctgggtcttgcctagcggcgggcgcatgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaaaaaaa

SEQ ID NO: 40 - DNA, 1242 bp, Homo sapiens
  source (1)..(1242): /organism="Homo sapiens" /note="NM_016523" /mol_type="unassigned DNA"
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaa

SEQ ID NO: 41 - DNA, 2545 bp, Homo sapiens
  source (1)..(2545): /organism="Homo sapiens" /note="NM_053282" /mol_type="unassigned DNA"
ctagaggaagaggtagctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcccatctccaggtcttagtttctttgtctctgtggttgggtgggatgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttattgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactgtggctggagccccaaagtgtggagcattgtgagatttggggtcacagcaatttatggctactattccctgggtctggtaggtaggacaaatgtcctcttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttcccatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgcaatacctatgctcatttattttttatgtttacccattggttagggcctcctgtatacattaaacagttcatagtcatgatagtgagtattcttacactgttcccagtattacagggaatgcttagaaattttctttatttaaacattatgtttgttgtagccttgttaaaggctattttataatttttactagaaatattttgacatttattgtgatttttttctatctctaatctattgagatagtcacattccttttgtcttcactccattataaaggtaagttaccttaataaaattgttgatatcatttcatcaaaaaaaaaa

SEQ ID NO: 42 - DNA, 3942 bp, Homo sapiens
  source (1)..(3942): /organism="Homo sapiens" /note="NM_001004441" /mol_type="unassigned DNA"
tgctggcccccctgggtccagaggagccttgccgccctcacctgcgcagagcctggagccgacgcgtcacccccagcggaagcgcctcgctgcccgggcgtctggcgaggtgtgcgctccgggtcccagctccagcgcttcgcggcagtcgcccgcctctttccgcaagcagggcggggactgggcggcatctaccgagatctgcgattcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagttgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagagtcccccattattaatgcaccagaacagagtggcttcattgcaagaggagctccaggatattacaccagaggaagaactatcctataaaaccaatgggctggcactttccaagcggttcatcactaggcaccaaagcattgatgtaaaagacactgcacatttgctaagagcctttgatcaggccagctcaaggaagatgtcatatgatgaaataaattgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaaaggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacaaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacaccgacagctgtaaaatgttctaagataaaaaaactcgagctacaaagaaagaatgaactaattctttacaaatgttgactgaagatagataaaactctaattaaaaatttaaaaggttaaacactgtattagaatgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaaagaaccaaaaaaaaaaaattcatcatggataaaaactaagcgcttgccttcttttaaaaagaaaaactgatgattagattaggttagctaaaattaatagaggcagtagaaacttaatcacaaaatgtactaaatatttggcaatattaaacaatgcctttttatttctgatatgtagttattagacatttatatattaaggataacttccttagtgtgacattccaatcatttagtattttaggacctgtgaataacttccaacaaaattaatgaataccatattagtattataaaatattataaagtaataattatatcatctatataacttcaaagtatgatgtttatacaaagaatccttatttcagtctagcagcttaacaacaaaggataaatcagactatacaaaacctaagtgtattaatttgatgattgtcacgtacaactttctttgccttccaagtagaggtgatcctaacaattggcatgatgcttttcttggtaatttgatataagcaagttgtaatgtacatagtaattatttaattactgtggcttttattttaaaaagtaattagaggtttttccatttcatgtcttgaacaacattaatattaattacactagaaatattttttgattcagaacttagaattgtacctgatatttataggtatttaaatgctttctgcaagttaaatatcgagaaaagtacttgacttcaagttgtaaggatacaatttggaagggtatgtaaatagattagttcataaacaaaatggtatcaataaagattttaaatatcaaaaaaaa

SEQ ID NO: 43 - DNA, 6156 bp, Homo sapiens
  source (1)..(6156): /organism="Homo sapiens" /note="NM_001136258" /mol_type="unassigned DNA"
attgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacggagctgcatcctgtggccctataacactcttctccaaaaggacctgccagagactgggagtgttgactgctgcaaggaccaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctacagccactgtgtaaatagaactgcctaatgttgagagtggtttttagcattaggtttagcaagggggagatccgtgggttgtgcgtcagctttgggtgaattttgtttctaccctgtcacggggaaagttcgggttgagtccaggagtgcacactgctgctgccacccaatgcgctacatatcacttttttttgttttgttttgttttgtttttaaaagatcattttatcttaaaaaggaaagctgatccaagtaaacacgaaagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtactttatggaaaaaccaagatggaacctgaaagttaatgtatccttgcttttagcaagagactcagtttcttataactagtcctaaggacatatgccgcaattgagtaattttacttttaccctatgaaaataacatggtgctgcactataatatactctcggaatcagtgtgttagttacagctatacagtgaagggggataactgtttctaaatttctttaaggtgatgccaaaaaatggattaaaaaatctgatcagatttaatgttaccagatttagtgcattatttaatgctattggatcttttggataattcttggcttaatttcttagctacttgaaggttaatttgcaagacttttaaaaccttagaaaagttttaaggttgcaaagttatcaacactggggcagagggtggagaggccaatgcgggtagaaggaggcagttatgtttatattgaaggtgaaatttttctttcatttagaatggaaaacatccccaaatgtatcattataaactagtcagccttgactacacaaaattgacctttaagttgcttgagaaaaacacaatgcaaatcgttcagaagggtcaacatcctttggtgctaaaatcttgtgtatgttttcagaatggctttttctgtatgttatagaataatcactaaaggaaaggtagttgaatttaaagtcatgaagcaagactctttaattcagttattttaaacaagaattaaaaccccaaacatccttggcaggctttgaagcacacagaattttctagtatttcttattaaatacaccaataataaacatatacttagtttacctgatgagtttagacataattctatataatgttcgcttatattcatttattaactagcaacacttgtgcaagaacaaggtattctgcttgaaaacactgatttttaagttcctgttgcccgattgtaaagaaaatcatctgacacagaagcctggattttgctctcctaacactggtgttttccttgagcctctaattcaaataaaacaaactgatacaccttacagccttattcatctgtgtctggataactcacttttcatctattgaataagaaaaagtgtttaaacttaataaaataaaaaattgtgcaccaattactacagatccttgaaacagtaagccttggattttagtcaagtaatccagtttttttttaatttaaaaaaaaccatcaccttttaaagaactttaaaaacacctgtgatgccaatgtggacattgccgctgccatgtctttacacgcatgtgtcgtatagctctgtcatcgagttgaggaagtccatggtttgcaaataagggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatcctttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacaccacttttaaaagcctgttttcaagtttttgaaaggcatttgttttctgttgtttgccaataatctgaaagtatcatgtgaaaggaattattttaaaagcattttaaacctttcccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaaaaaaaaaaa

SEQ ID NO: 44 - DNA, 4131 bp, Homo sapiens
  source (1)..(4131): /organism="Homo sapiens" /note="NM_032047" /mol_type="unassigned DNA"
atcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatgaaaaaaaaa

SEQ ID NO: 45 - DNA, 2232 bp, Homo sapiens
  source (1)..(2232): /organism="Homo sapiens" /note="NR_026575" /mol_type="unassigned DNA"
agaaaggtccaacagaccctggaactgcagtctaaggtgatgaatgggtttgtggggggaagatgatagtcacagggagctatgaaggagtctcacgtgagccaacagtatagattctgaaggcgtttatggcaggagaaacaaaatacgcagggaaagataatctcagtgttaaagacagatgtatgcctggaggccaagacagaaaatgagctgcagagagaacgcagtagcctgctagccagccagtaaagaagtgaggctagttcagcggactcgcgcggcctcgctctttggactcgtcaccctcccctccccctcccgccgccgtcacccaggaaaccggccgcaaacgcgggcggacctgaagctggtttcatggcagcctcaaagaaggcagttttggggccattggtgggggcagtggaccaaggcaccagttccacgcgctttttggttttcaattcaagaacagctgaactacttagtcatcatcaagtggaaataaaacaagagttcccaagagaaggatgggtggaacaggaccctaaggaaattctacattctgtctatgagtgtatagagaaaacatgtgagaaacttggacagctcaatattggtatttccaacataaaagctattggtgtcagcaaccagagggaaaccaccgtagtctgggacaagataactggagagcctctctacaatgctgtggtgtggcttgatctaagaacacagtctaccgttgagagtcttagtaaaagaattccaggaaataataactttgtcaagtccaagacaggccttccacttagcacttacttcagtgcagtgaaacttcgctggctcctcgacaatgtgagaaaagttcaaaaggccgttgaagaaaaacgagctctttttgggactattgattcatggcttatttggagtttgacaggaggcgtcaatggaggtgtccactgtacagatgtaacaaatgcaagtaggactatgcttttcaacattcattctttggaatgggataaacaactctgtgaattttttggaattccaatggaaattcttccacatgttcggagttcttctgagatctatggcctaatgaaagcgggggccttggaaggtgtgccaatatctgggtgtttaggggaccagtctgctgcactggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccggtatattacgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcaattcacgaataaatgccatattgcttttgctgcattagaagctgtttgtttccaaactcgagagattttggatgccatgaatcgagactgtggaattccactcagtcatttgcaggttgatggaggaatgaccagcaacaaaattcttatgcagctacaagcagacattctgtatattccagtagtgaagcccttgatgcccgaaaccactgcactgggtgctgccatggcggcaggggctgcagaaggagtcgacgtatggagtcttgaacctgaggatttgtccgccgtcacgatggagcggtttgaacctcagattaatgctgaggaaagtgaaattcgttattctacatggaagaaagctgtgatgaagtcaatgggttgggttacaactcaatctccagaaggtggtgaccctagtgtcttctgtagtctgcccttgggcttttttatagtgagtagcatggcaatgttaatcggagcaaggtacatctcaggtattccataaaacctaccaactcatggattcccaagatgcgagctttttacataatgaaagaacaacccagcaattgtctcttaatgcgatgacactattcatagactttgattttatttataagccacttgctgcgtgaccctccaagtagacctgtggcttaaaataaagaaaatgcagcaaaaagaatgctatagaaat

SEQ ID NO: 46 - DNA, 7073 bp, Homo sapiens
  source (1)..(7073): /organism="Homo sapiens" /note="NM_006212" /mol_type="unassigned DNA"
ggtcccggccacaagctgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacactcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatgaccatttttttcccaaatgtggaaaagcttgatgatgaatttaatctctctcattggagtattcttttgttcataaagagaaactatctcatcttgatgtccagagaagtccttggaaccctgtgggatctagctcgtaactgtttgtatttctctattcacttctgtcatttcattttctttgtagggttaaacagaaaatgtttagggaagaaattcttagccccttgatgaccatgatggcttattctctttcccaattttgcatgcaaaatgtacgaatatatgtatgtttttctgagaggcaagtttagggttctcatgggattttaaaaagagataggtgactccccaccttaaagttatctgctggtcttttagaggtaaccagtgagaaggagttagctattttccaagggtgttttcatttggtaatggaagactttttgctgtggttctcatccaggagtattccttagaattgcctttaggattgttgaatcataaacatgcctgtgtccaccttatgcttaatactgactcagaatctctgggatctgggtctggacatgcatgtatttaagtagcttcccggatgattctgattcatagctcgggttaagaactccaccttaggaagttaggtggaaaaatactggatagtagtttctcagacaaaagtgtcagcctaggaattctgaattcctcatagtcctgaaaggacagttctttgggtttgatgtttgagcagatcataatgttaaatgatataaccccctggaaggcaggctgctgtgttttagagggttattctaggttctagtcccatctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggctgaggcaggagaatcacttgagaccagcctgggcaatatagtgagacctcacctctaaaaaagttttttataaatttacttgtctaaagtggggaaagggaaattattctgttttcttattcttgcttcaagactatgacagatttgaaagagaattctaaagcagatttagagaacctgcttctcttcttatctcctaatccctaaattgtaatttagctcttatctgtattgttgttttgttttggtaaagggatgatttttacattgagttttaaagtagaataagaaaagcttctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttcttttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacgtgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaacattctgatttaatcgggtgacactgataacaaagtatgccactcagatccatttaaagtgtgcataactgtatttgaaatgtgtttttgtgtgcgtgtgtgtagaatgggtaaataaaattgttgagtaacttgaaccta

SEQ ID NO: 47 - DNA, 4161 bp, Homo sapiens
  source (1)..(4161): /organism="Homo sapiens" /note="NM_007166" /mol_type="unassigned DNA"
ggagcctggcgccgccattttcctgcagctgcctgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactggaaaaaaaaaa

SEQ ID NO: 48 - DNA, 1518 bp, Homo sapiens
  source (1)..(1518): /organism="Homo sapiens" /note="NM_152637" /mol_type="unassigned DNA"
aaaagtcattgaagagcttgtggggctgtgggacctgcgccctctggaggaattccatacacccactcaactctggcaaataggaaattgtcaagtaggagacaaggagcaaagtcctatcacagcgggaggggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaataatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacgaaaaaaaaaaaaaaa

SEQ ID NO: 49 - DNA, 390 bp, Homo sapiens
  source (1)..(390): /organism="Homo sapiens" /note="NM_003542" /mol_type="unassigned DNA"
atgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctca

SEQ ID NO: 50 - DNA, 1885 bp, Homo sapiens
  source (1)..(1885): /organism="Homo sapiens" /note="NM_145005" /mol_type="unassigned DNA"
acgtaacctacggtgtcccgctaggaaagagaggtgcgtcaaacagcgacaagttccgcccacgtaaaagatgacgcttgatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagaaaataacagactgtctacttagattgttctagggacattacgtatttgaactgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggcaaaaaaaaaaaa

SEQ ID NO: 51 - DNA, 477 bp, Homo sapiens
  source (1)..(477): /organism="Homo sapiens" /note="NM_003533" /mol_type="unassigned DNA"
ttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctca

SEQ ID NO: 52 - DNA, 5523 bp, Homo sapiens
  source (1)..(5523): /organism="Homo sapiens" /note="NM_021082" /mol_type="unassigned DNA"
aagctattgaagctgacacccacagagttaaactcagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagaactagcacctgcctttcttcaaacaatgcacttctgttaatgcagtgtaaggtaacatgagttgtttttggaaactacatcataatgtgggcttacattctagcacttatcacttaatgacagggatacatttgaggaatgcattgttaggcaattttgtcattatgcaaacatcatagagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccaccatcacatatttggtctgtcattgactgaaactgcaatatagagtttttcttaacatttgcatattaaagactctgactatatatgg

SEQ ID NO: 53 - DNA, 3990 bp, Homo sapiens
  source (1)..(3990): /organism="Homo sapiens" /note="NM_030956" /mol_type="unassigned DNA"
agccaattctgaccgtgtcaacgaatcatccacgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 54 - DNA, 1449 bp, Homo sapiens
  source (1)..(1449): /organism="Homo sapiens" /note="NM_001124" /mol_type="unassigned DNA"
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 55 - DNA, 3691 bp, Homo sapiens
  source (1)..(3691): /organism="Homo sapiens" /note="NM_014143" /mol_type="unassigned DNA"
ggcgcaacgctgagcagctggcgcgtcccgcgcggccccagttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagttaaaaaa

SEQ ID NO: 56 - DNA, 479 bp, Homo sapiens
  source (1)..(479): /organism="Homo sapiens" /note="NM_001311" /mol_type="unassigned DNA"
gcgctgggctaggggcgcggcttgaactcgcctaaagagctgcgccctctcatctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaa

SEQ ID NO: 57 - DNA, 3734 bp, Homo sapiens
  source (1)..(3734): /organism="Homo sapiens" /note="NM_001099660" /mol_type="unassigned DNA"
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctgggaaaaaaaaa

SEQ ID NO: 58 - DNA, 4055 bp, Homo sapiens
  source (1)..(4055): /organism="Homo sapiens" /note="NM_002121" /mol_type="unassigned DNA"
gtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagaga

SEQ ID NO: 59 - DNA, 2166 bp, Homo sapiens
  source (1)..(2166): /organism="Homo sapiens" /note="NM_014232" /mol_type="unassigned DNA"
atctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttttagaccccccatattatcccagtgtcccctgcccccctcttcccccaccccatgcccccaattctgtggcgcatccagattgtgaaaatgtacaataaatgtgtaatgagtaaccaggaaaaaaaaaaa

SEQ ID NO: 60 - DNA, 2203 bp, Homo sapiens
  source (1)..(2203): /organism="Homo sapiens" /note="NM_006714" /mol_type="unassigned DNA"
gctttgcaaccagctgcggatgcctggacgtctaattgctcaaaggtgttatctgagactgaagaaacagacttttcccctggattctttgaaaatccccctctcttattctctagcagaataaaaactccctgctttttcctttttacacacggatttgagagatcttgttctccctccttctggcttttactaaattgaatgtctttctctatccccaagcaccagtatgtcagtgtttgacatcaactgcaccactgatacacgagtcggaatttgagcttctacaagtacattccttcctaggccaaacactgacgctaagaaatacgagaacagatcatcgctaaacagcagctgaaggtcaggcgaactgactcgctgcggaatctgcctttgcacgtgatcagtcggacgtctacacccgcagccgtcttctgtctccgcctcaccctcaggcctgacggtccgagtggagctgcgggacagcccgaacctccaggtcagccccgcggccctccatggcgctggtgcgcgcactcgtctgctgcctgctgactgcctggcactgccgctccggcctcgggctgcccgtggcgcccgcaggcggcaggaatcctcctccggcgataggacagttttggcatgtgactgacttacacttagaccctacttaccacatcacagatgaccacacaaaagtgtgtgcttcatctaaaggtgcaaatgcctccaaccctggcccttttggagatgttctgtgtgattctccatatcaacttattttgtcagcatttgattttattaaaaattctggacaagaagcatctttcatgatatggacaggggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatcctggtatcagactgtttcagtatgatcctcgtgattataaattattggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctctaaaaaaaaaaa

SEQ ID NO: 61 - DNA, 2740 bp, Homo sapiens
  source (1)..(2740): /organism="Homo sapiens" /note="NM_005531" /mol_type="unassigned DNA"
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaaaaaaaa

SEQ ID NO: 62 - DNA, 2377 bp, Homo sapiens
  source (1)..(2377): /organism="Homo sapiens" /note="NM_016475" /mol_type="unassigned DNA"
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacaaaa

SEQ ID NO: 63 - DNA, 414 bp, Homo sapiens
  source (1)..(414): /organism="Homo sapiens" /note="ENST00000371443" /mol_type="unassigned DNA"
atgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctag

SEQ ID NO: 64 - DNA, 4177 bp, Homo sapiens
  source (1)..(4177): /organism="Homo sapiens" /note="NM_004172" /mol_type="unassigned DNA"
gctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaaaaaaaaa

SEQ ID NO: 65 - DNA, 2930 bp, Homo sapiens
  source (1)..(2930): /organism="Homo sapiens" /note="NM_006418" /mol_type="unassigned DNA"
ttttcctacatgctggccatggggaaatcaccactgggcactataagaagcccctgggctctctgcagagccagcggctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaaaaaaaaa

SEQ ID NO: 66 - DNA, 3179 bp, Homo sapiens
  source (1)..(3179): /organism="Homo sapiens" /note="NM_001164116" /mol_type="unassigned DNA"
gaagagtggtgtttttttcttcttcttcttcttttgtggtttcacatagcaaatgagtgacagtctctacttacagacaaagtgagacgtcaggcattgagacatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtgggcagggtgttcccctgatatcagtgactaccttaagaagaggcggttacagcacattaccaaatcctcagaaatcggaatggatttatgacactccagtgtctccaggaaaggccagcgtcagaaacacgcctctcaccagctttgcggaagaatcaaggccccacgctctccccagttccagctccactttctacaatcctccaagtggcagatccaggtccctcactccacaactgaataacaatgtgcccatgcagaaaaaactcagccttccagaaattccttcttatggctttcttgtacccagaggcacatttcctttggatgaagatgtcagctacaaggttccttcaagctttctgattccccgagtggaacagcagaacaccaagcccaatatttatgacatccctaaagcaacgtcgagtgtttctcaggctgggaaggagctggagaaagccaaggaggtgtcagagaattccgcgggccataattcctcatggttctccagacggacaacttccccatctcctgaaccggacagattatcaggttccagttctgacagcagagctagcatcgtttcctcgtgctccaccacatccaccgacgactcctccagctcttcctcggaggagtcagcaaaggagctctccttggacctggatgtggccaaggagacagtgatggctctgcagcacaaggtggtcagctctgtcgctggcctgatgctctttgtcagcaggaagtggagattccgagactatctggaggccaacattgatgcaatccacaggtccactgatcacatagaagaatctgtaagagaatttctggattttgcccgaggagtccatgggactgcctgtaacctcactgacagtaaccttcagaacagaattcgggaccagatgcagaccatctccaactcctaccgcatcctgcttgaaacaaaggaaagcttggataatcgcaattggcctctggaagttcttgtgactgacagtgtccagaacagcccagatgaccttgagaggtttgtcatggtggcacggatgcttccagaagacatcaagaggtttgcctccattgtcattgccaatggaaggctcctttttaagcggaactgtgaaaaggaagagactgtgcagttgaccccaaatgcagaatttaagtgtgaaaaatacatccagcctccccaaagagaaactgaatcacaccaaaagagtaccccttccactaagcaaagggaagatgaacactcttctgaactattaaagaaaaatagggcaaatatctgtggacagaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacctctcagcttcacacccacaacttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccag

SEQ ID NO: 67 - DNA, 2752 bp, Homo sapiens
  source (1)..(2752): /organism="Homo sapiens" /note="ENST00000533734" /mol_type="unassigned DNA"
accacctgatcgacaagctagaaaataaattccaagcagaaattgaaaatatgggtaagaattaaatatttagagaccctagactaccttgtcttctcctccactgattcaaaactatatgaagtttccctccactctttccttctcttcatcccgttcatctcactatgtctttgagggcacttccctttttctctttcagtatgcatcttgaattttctttttaaatatgttcagctgagcattgaccctatgtcaagtactactttacatatgatggcagaaacacacacacacatacacacacacacacacatgcacacacacaagtcaccattctctaatcgtccaggagcttggctttaagtcaaatgatgaattacaccagaaatagctgaacaatacaggatacagtgtcataagtaccaaaatatacaatgctagtatatgagctaaaggtggccagagtacattatcactgggaaaaatcaaccggccatggtggccactagtgaggtgcactgtttttatttcagttcccacccaatatttattctatttttcagtaagtccattttcctttgagatggcctctaacctaggtttctacttacagtttcaacaccttactattgaaaacgcaagaggcttggaggttgaaaacctgtattctggccctaactctgtaaccatctgaatatctagatagcatcttaatctctttaagactgtgtcccctcagttataaaatgaaagaaattgagcggaatttagtggcccttaaaagccctcacatttctcaggttttctgattctatgggtgacctcccccttctattagccacctttccttaaatgtaaagaaattaaaatagagtaagtaggaatagatggaaaatgcatacgccattaccacttccatgattaagggaggtatttcttctcttttctagaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtaggtgagttactaagcccaattcccttggtacagaggacatggtcaccagtaggtcttgctctttgagtttttctaccagtaagtacctggattttattttctaccctctttgctctagtcccctcaaaagggaattttctttttgagaagaatggatgatggatggcatttaagcttctttctagatgtgtggtatagtagaaatacccggtttctgctccagctcttctttgggttatataaacaatgaatgttaactcttgatcttaatttttccatttgtaagatgaggataaggcatgagaatatccacatgaaatattttagaaagggtaagttttagaaaagggaaatgcaatggaattcgtttatcttaacactgtctctttctctagtttattgggacaatttggatacctcgagagtcttgaacaataccacctctccagtgacaaagtccaatattttaatcaatagattgtatattcaccttgggaaatgaaccagaaatttcccactgtgtcagccttaatatccataaagaagtctttagacagttagtataggtgcttagcctctatggatccagatatacaagttcatctttctccaaattcaaagttcaaattgaagttcaaagcaaatcaccatgtagtatttctggatagtaaggagaatgtgagatttctcagacttcttttcccatgagagaggaaaggtcccatgctaaagaacacaggagacaccaagtatcaagccagaaaacgtgtccttatctttccttcttccagtctcttgcctcatcctcttttgtaaagaggtttactgggcaacaactctgtaaagtactattttctaatcagtctaatgaaacccttgagagccttacaaagacagtttatttgattcagcctcttaggttttctcaatccctcagccaacatggctaaaagattagagaaagatggaaaagatgagagcaaccaagatgtaaaagtgaaatactgtccatgtgtatgcacctacaaatccataggtgttttatgaccaaaatatgtgtaaaaaaagaaacccagaattgtatttaaaaaaaaaaaaaggcagggtgcagtggctcacacctgttatcccagcactttgggaggccgaggcgggtggatcacctgaggtcgggagttcaagaccagcctcgccaacatggtgaaaccccgtctctactaaaaatacaaaattagctgggcgtggtggctcactcctgtaatcccagctactcaggaggctgaggcaggagaatcactagaacccaggaggcagagttcgcagggagatcggaccacagcactccagcctgggcagcaagagcgagactccgtctcaaaaaaaaccaaaaaacaaaaaacaaacaaacaaaaaacactccagacagcagcaagagagctttagagattcgtgctacatcccaccctaaactgcttttaagctaatttcctggctttttacctgctatgtgtgtgtgatgggtctcttttccttggcaagttcttagatgctttccaggatgtttggattctcaaagacacctgttcctcagctgggctccatggcctgggcttcagacagttcaggcagcagacatatctttgc

SEQ ID NO: 68 - DNA, 2825 bp, Homo sapiens
  source (1)..(2825): /organism="Homo sapiens" /note="NM_018639" /mol_type="unassigned DNA"
ggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaaaaa

SEQ ID NO: 69 - DNA, 1350 bp, Homo sapiens
  source (1)..(1350): /organism="Homo sapiens" /note="ENST00000405140" /mol_type="unassigned DNA"
atgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtga

SEQ ID NO: 70 - DNA, 12900 bp, Homo sapiens
  source (1)..(12900): /organism="Homo sapiens" /note="NM_001163278" /mol_type="unassigned DNA"
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagaaacagagataccagacatagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttggcagaacttacgggctatttgaataggtggtgcaatagtatctgaaacttgcctttcgaaagactgccagccctttgacgttttccagatctgttataggaaacttaaaaacaggtgtaaaatgtcttcagccaccatctcctagagtgaggacccaattgcccttccttcttgattattcctccttgcttgttaaagtaaatgccatattgttgtgctgtgttttggcgtgtggtggctgggttctgtctaccatgcttccctgtgggtgtggtaaccagactgtatagccgctatttgctcgtgtgtacatgataccaaagcagctggccagcgtgacctctctcacacgacctgttttgactcaattttttactaaaagttgttcagctgtattggtatcatgtaaacatagcttttattaacctgggtaggaatttctcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatagagaggcagactcatttttactaaaataatttatacagttagttattttcgttctccgtacttacccatttatctttatttaatcgtctctactgcctaggaaaataactattttccaggacgggttatttgttctgcgatcatttaaaatttggagaaaggtcaggattagtgttaatatcagctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctgagccagcttctgcactttcatcaccgaatctgaacatttgctatgtctgaaggcaaatttatgatggaatgttagtttggattctttccagatgctacctaaatgcagtgtggggtcattgccttgctttgcgatgacagtttctttgaaaatatgcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtattttatcacaaatccaaaatgtcaatattagagtctattttgcttatattttaagcaattatacgtttttgcaattcattgatgatgtatcattttcaaactgctttaaatatccattagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaagaaaaaaaaaacaaaactactaatcagtagtaaatcgaagagaaacattttggcatttcttaagaagaagatggagatattgagtatatcacttcctattcagctgaatagaaagaatgccttcattgacttgcagttctgcagtttaaattattgaaagaacaattcgtttgcatttcctgatgaaagtaaaagcatttttcagagaaacatatgaatttctcatacccagcagacagatggctgacactgcacagccacacaccattcgagtaagttaaagtgagagcatagtagttggactctcctatgaagaacattctgggctggaggcagggaatactccatggttgtttctttttcctacttaagcccattttgtttgtgcttttctgttttgttttgttttcactcttgcactacagtctagagatccaaatgaactgaaaagttcaaagtttaacacatttaaatatgtttacttttagttgtcattctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatctagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatgaaaaaaaaa

SEQ ID NO: 71 - DNA, 2167 bp, Homo sapiens
  source (1)..(2167): /organism="Homo sapiens" /note="NM_002269" /mol_type="unassigned DNA"
ggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgtaaaaaaaaaa

SEQ ID NO: 72 - DNA, 1003 bp, Homo sapiens
  source (1)..(1003): /organism="Homo sapiens" /note="NM_001130715" /mol_type="unassigned DNA"
agttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgagtcaatgcaaacatgcctctcagaacatgtgggtttttagaaatatcactaaagactttgtcaattatttgttgttttgaataattcagcaataactatttcttaagtctcctgaagtgctatcataatatcaagattggctttaattttcttcttatgaagaagatagctctatactttgaaaccatattttagtaaataaaggaatggtgaattttctaaacttctcagaattctggtgatctattaaggaagcacttaccacttgtaaaataccagagtatggtgagatacaaaagaattagaaaacatgttccctgctaagacaaacaagttgacaaaaggaattcgtaaataattataaaatagaagagtaaagaaaataacattctgtatgatatttggattgattgtggcataaagcatctatcatagcaaggtgaggttaaatagaaaactcctgttggagaagctgaactttgaaagaggtgaacatagaatttagaatgtttggaaatgt

SEQ ID NO: 73 - DNA, 806 bp, Homo sapiens
  source (1)..(806): /organism="Homo sapiens" /note="NM_001257400" /mol_type="unassigned DNA"
gcccctctccccctttccctcctcccagcgcttgggggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtg

SEQ ID NO: 74 - DNA, 4660 bp, Homo sapiens
  source (1)..(4660): /organism="Homo sapiens" /note="NM_006665" /mol_type="unassigned DNA"
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttgaaaaaaaaa

SEQ ID NO: 75 - DNA, 3229 bp, Homo sapiens
  source (1)..(3229): /organism="Homo sapiens" /note="NM_152367" /mol_type="unassigned DNA"
atttttactgccagctttcaagttggaagagggaaattacgtttaaaggtcagcagatgacagatggattttcacaatttggaaataaaaacatgagtgaagggttcggaaggcaagtctctggtccattacacacttccagaaaaacttagtacccagagactcacattactgggagtgctatctactcacaagtgttgcactccattgagaaaaaaaaaaaaaccaggaagttgctgttctactgaggactgaccaagaagccatgaaataccttactgtgggagacttagaagattgcctactgaataaggtggacttgaggcgccagcagatttcccaggctgtggaggaggtgcagaaagtcgttcatcatttgaccacaaacatcagcaaccaagacattagatttcaagctgtgccttactctgacacgtacaatgaaaatattaaggttttggctcccagtcagttcctcgtcacagtcccaataaaaggcctggccgggtacagggaggccagggagcagcactggcggtactacacactgcagggcaccaggctgccctgcccgttgcgggaccctgagggtctgcagcagtggctggaggtggaacagtttatgaagagcctgtggcagtggcatgagacagatgtgaacatcgacggagacattgtgcctgccaaggtcctcctagtgttccggaagctggtggaaaatgcagttagaacctgtcacctctcaggtaaggtcagcctgctaggaaaccgctctgcagtttgggttgctgtggaaacatctgcatatcaggtggaactggagctggtccccgcagtggagatccccaccacctggtccaagaaagcccggtggcctcgatgtctgcagcgctggccttcccaagagagagtggagtgcatcaagtcgtttggatttaacttgttggcctgttcaaattatcactggcagctgagcttcctccgtgctgagcaggtgttactggaacagctggatgaagatgggggctgccgtaggaagtgttttcaggtcatgaggcacctgaaggaggacatctggtgcccagggaacaggccggttatcacgtcccaccatctgcagactgtgctcttttggacctgcgagaaatatccccactttaaagactggcaggtcttcagcaaagcatttctgcgcctggtgaggaaactgcacaagtgcgtgagccagcacttcctgaaacactatttcgtccggaacagcaacctctttcagtgcaccaacccgactgaactggacactgtggcccaaaagctggccaccttcctgaagaacccccagatcggcccgccctgatggttgccccggcctgggaggctcttggacattttattctggcttaacattgttctttggatggttcctcagtcaggtgccaggatcctgcctaggagaaaggccacgaatggcagcggaaattacatcaaaccagaaacacttcagcagggggaaaactgtgccccaggatgtctggcccaggcctccctggagcccagcaagcatttctgccctagctaattctcctggagacagctctcatcaggcttccccaggcacagatttggaactggtgacagttctgaacttagtttcccttgttcaggctgtgatcgtctcacagtgaagatggagacagaacccctggaagtctggacatgagcctgctggccaatactgtgcccagcccactgatcatgggcacattctcctgccatttgtaaaatgggaatgttaacgtgcctacctctgagcagggctgtgtgcctatgaaactgtgctggcgccttttcaaggggaaggcattggatcaacacaaagtgttcctggttggttgagtagctggtgtttgcatcctggatcggtacccacagcactgacgcaaaattgcacctgatgagttagtgagcctgtgcttccttgctgccctccagcttccttagcatgtgggtcagtggctcctgatgttctgtctgcttcgctggtattctctaagcagggaggggaatggttttgatgataagtgtaagtcaaagatgaaagtacaactcttggcctgatcccaaccatagccctctctttgcttcccatgccatgggccatggatggaacttccttatatatttatgtaaataacctagtactatgatctgcatggagtgaccttaggtgtctgtcactgctcagtgtgttcctttgctcacttcattcactcactcactcattgacaaataatgctcattaggcaccgggaacacagcaaagagcaaagtggatgaggacctccccctggggatgccacctaatggtggagacaagaaatgaacgacagataaacacgcacagttattacagatggaagcaagtgcttcaaaggaaataaacagaatgttgaagtagagtccacagaaaggtccccgaaggatgaaaatgcaaatagctgaaggggaaggaaaagtgaccaaaggcaggcatggtggggctggcatgagtcagagcacctggccttgtaaagccaggaaggaatcagtattttattctaagatcaaaggtgtgacatttggcctctccagaagcagaagagtatcacgatctgactgcattttaaacaattgttctggtaactgcatgaagaaggtctggggactcacacaggagctgggcactgagtgctcttgagccacccatttggaatttcacagaggcccacaaggcaacatattctgtgtggcacaaccgatcaggaattctaggagttctcggtgagatcaatggtttttttctggcgtttatgtaatgcttctcaactcaaggggctcctttattacttttgaatgtttttgcccaaatgtctataccaaagataaatttctaaagcatgaactactgattttgttttcatgaaaattcacatttgaaaatgaaaatgattacttttcaaaagtactgtaaacggcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatagatccaggagctggttttttgaaaggatcaacaaaattgatagactgctagcaagactaat

SEQ ID NO: 76 - DNA, 858 bp, Homo sapiens
  source (1)..(858): /organism="Homo sapiens" /note="ENST00000443533" /mol_type="unassigned DNA"
atggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctga

SEQ ID NO: 77 - DNA, 1947 bp, Homo sapiens
  source (1)..(1947): /organism="Homo sapiens" /note="NM_001199805" /mol_type="unassigned DNA"
agaataaaaaacatttgccaagacctcatgcccttttagtaaacgaatgtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgctactggggataaaggaaggagaaataagtcaactaaaatttgagcacctgctaataggtatgtgtggggacttcccagttggctgtaagttgccatttgaactaaacgaaataggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 78 - DNA, 7337 bp, Homo sapiens
  source (1)..(7337): /organism="Homo sapiens" /note="NM_024524" /mol_type="unassigned DNA"
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataaaaaaaaaaa

SEQ ID NO: 79 - DNA, 4366 bp, Homo sapiens
  source (1)..(4366): /organism="Homo sapiens" /note="NM_005546" /mol_type="unassigned DNA"
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat

SEQ ID NO: 80 - DNA, 1946 bp, Homo sapiens
  source (1)..(1946): /organism="Homo sapiens" /note="NM_021127" /mol_type="unassigned DNA"
actggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttcaaaaaaaaaa

SEQ ID NO: 81 - DNA, 2043 bp, Homo sapiens
  source (1)..(2043): /organism="Homo sapiens" /note="NR_046099" /mol_type="unassigned DNA"
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaagtaaaatgctgacaacatgagcctcccgtggtcggaacgggcttgtgaaggcggtgctggggtgcaccagggcagcagctacagaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggagctcctgccttgtcactgtgtccccaaacgaaccgcatctgaatcaagcccctttctctccctagtggtcaacatctgggctgtgatgggcagctcccactcttgccttagaatatgactggagaggtgacttctcatcacatggagaatatgttcaccccatggtgctttccacccaagctgaccatggcttgactttttggtgtagttgctagctctgtgccatccttggcaatgtgaccctggagcagctgtccccagtgtgcatttgggggatttcatgtaattatgaataggatgcaaattttatagccccagtgaagggaaacacccctggcgaggcttcccggggccagagagaggactccactgagggagatggtggcagggccattctttgtgtcctgcttttttttttttttttttttttaacatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagtgagtatcagtttctgcaagagaatctaatgcaggctttgcttctcatcggaatcccccagctggtgtcttggttgactgagagtctgggggagagggcagagaatggatttattctctgctaggtttttaacagtcaagaagggctgtggtcctaaggggcactggtcaaaccttagtgtgcatcagaattatctggataaggctaggcacagtggctcacgcctgtaatcacagcactttgggaggctgaggcgcgtggatcacctgaggtcagaagttcaagaccagcctggctcttttagtagagaaaccctatgtctattaaaaagtacaaaatttagccaggtgtggtggtgagtgcctgtaatcccagctacttgggaggctgaggcaggacagtcacttgaatctaggaggcagaggttgcagtgaactgagatcgtgccattgtgctccagcctgggcaacaagagtgaaactctatctc

SEQ ID NO: 82 - DNA, 2457 bp, Homo sapiens
  source (1)..(2457): /organism="Homo sapiens" /note="NM_002080" /mol_type="unassigned DNA"
tctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgctgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaa

SEQ ID NO: 83 - DNA, 3079 bp, Homo sapiens
  source (1)..(3079): /organism="Homo sapiens" /note="PDGFC" /mol_type="unassigned DNA"
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaattaaaaaaaaaaa

SEQ ID NO: 84 - DNA, 1651 bp, Homo sapiens
  source (1)..(1651): /organism="Homo sapiens" /note="NM_012200" /mol_type="unassigned DNA"
gggaccggaaatcaagtctacaaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctggaaaaaaaaaaa

SEQ ID NO: 85 - DNA, 377 bp, Homo sapiens
  source (1)..(377): /organism="Homo sapiens" /note="NM_003545" /mol_type="unassigned DNA"
atgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgccca

SEQ ID NO: 86 - DNA, 3036 bp, Homo sapiens
  source (1)..(3036): /organism="Homo sapiens" /note="NM_000860" /mol_type="unassigned DNA"
gctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggaggggaaaaaaaaa

SEQ ID NO: 87 - DNA, 1184 bp, Homo sapiens
  source (1)..(1184): /organism="Homo sapiens" /note="NM_031950" /mol_type="unassigned DNA"
cttgcagagaaagagtcttttgtgcagcaccctttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgtgtcgactgccgcaacacagaccagacctactggtgtgagtacagggggcagcccagcatgtgccaggctttcgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaatacgaaaaaaaaaaaaaa

SEQ ID NO: 88 - DNA, 2259 bp, Homo sapiens
  source (1)..(2259): /organism="Homo sapiens" /note="NM_181506" /mol_type="unassigned DNA"
acattgactgtaaaggaaccaatgtgaagagtggtgtttcctgagcaaacggtgacttaaaaaaaaaaaaaaaaaagtggtggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcagaatcaggctttcaacatcttgaaaaccttgcttgtttgtatttaggaagtaataatttaacaaaagtaccatcaaatgcctttgaagtacttaaaagtcttagaagactttctttgtctcataatcctattgaagcaatacagccctttgcatttaaaggacttgccaatctggaatacctcctcctgaaaaattcaagaattaggaatgttactagggatgggtttagtggaattaataatcttaaacatttgatcttaagtcataatgatttagagaatttaaattctgacacattcagtttgttaaagaatttaatttaccttaagttagatagaaacagaataattagcattgataatgatacatttgaaaatatgggagcatctttgaagatccttaatctgtcatttaataatcttacagccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaataattaaaaaaaaaa

SEQ ID NO: 89 - DNA, 3318 bp, Homo sapiens
  source (1)..(3318): /organism="Homo sapiens" /note="NM_018342" /mol_type="unassigned DNA"
aacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagcta

SEQ ID NO: 90 - DNA, 2676 bp, Homo sapiens
  source (1)..(2676): /organism="Homo sapiens" /note="gi|21749325" /mol_type="unassigned DNA"
tgctccggcggcttcgctgctagctcgcggcgacgtcgggccgattttcccaggatgacagagctgaggcagagggtggcccatgagccggttgcgccacccgaggacaagataattggagggtccaccatcactttgtcgcctgctcaatggttggctggagctgaggatcatcggttcccaccaatccctgttgccttacaccaggctcacggcttcccctaatgcagcctgtaactttttgatgactggacgcaacggacattagggagacacccagaaggaagaaagcacaagatttggtgacaggatgtcaacagagcagttacactaggaggaatgtttttggtgaaagataatgagatcatgggttttttttaaacaactttcgtgttattgcggttgacagtggactatccaaagagaactgttcctaccgatttttagaacatatattttggccaggcacagtgctgctcgcctgtaatcctagcttctagggaggctgaggcaggaggatcgcttgagcccaggagtttgagaccctgtctcaaaaaacaaaaacaaaaacatattttggagaacatttagggctggggctgaggatttagcagtcgcttgcagagacaagatactttgaagtctctaatttttcatttggctatcctggttcagcctgaaagaattctgacttaccttgtactactagttggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggtccatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctgggtatgtgccactcacagggggtgagcggcctccatggacagtggctacaaagagagatccccctccatcacctgccctctgaaaaaagctagcttcctccttcccaaagctgtaagccccaggatgaaggagaattgctcacgccaggtcagggtatgggcaggacagctttcccccaacatcagattgtttagaccagtggttttcaaagtgtgttctgtggatccctggagggccctgggatccttttagttgcgggggtagggtgggggggtctgtgaggtcacaactgtttcataattagactatgacattattttcctttttcaatgtgttgacatttgctgtgatacggcgcaaaagcagcagtggttaaaactgcgttaaggcagtgggttcctcatgccacacactcacagtacaaacaggccagttctaatgaatgtctatgaaatagtaaagttactaattttgttaaatcttgacctttgtacacacacctttttaacactctctactgaaatggaaagtatgtgtaaaacatttctgctaagtactgtagtacagtgcttgcctaaagggaaagcatgtgtgcagttgtttgagttgtgagctaaattagctgctttttttttagaaaagaaagtaaattttacttggaaagaaccaacaaattataatttttcagacttgggtatttggcagacatttttcttgaaaaggatgaagtgagcctatcactttaaagaaaacaactgaggctaggcacagtggctcacacctgaaatcccagcactttggaaggccgaggcaggcagatctcttgaggtcaggagttccagaccagcctgggtaacatggcgaaaccccgtctttactaaaaatacaaaaaaatatagctggggatggtggcgtgtgcctgtaatcccagctaccagctactcaggaggttgagttgcttgaacccaggaggcggaggatgcagtgagccaagatcgcaccactgcactccagcctgggtgacagagtgagactgtctc

SEQ ID NO: 91 - DNA, 1858 bp, Homo sapiens
  source (1)..(1858): /organism="Homo sapiens" /note="NM_001725" /mol_type="unassigned DNA"
ccgactcttttatagctccctggttcaacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccgagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccacacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaaaaaaaaaaa

SEQ ID NO: 92 - DNA, 912 bp, Homo sapiens
  source (1)..(912): /organism="Homo sapiens" /note="ENST00000379215" /mol_type="unassigned DNA"
atggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtga

SEQ ID NO: 93 - DNA, 1796 bp, Homo sapiens
  source (1)..(1796): /organism="Homo sapiens" /note="NM_001837" /mol_type="unassigned DNA"
ctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagcagatgagaagctggtaacagagaccaaaatagtttggagactaaagaatcattgcacatttcactgctgagttgtattggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagcttgttttttcagtgtgaataaataatcgtaagcaaca

SEQ ID NO: 94 - DNA, 3837 bp, Homo sapiens
  source (1)..(3837): /organism="Homo sapiens" /note="NM_014181" /mol_type="unassigned DNA"
ctttaaatgctgcccagggccgacgcggcacggccctcgccacttttcttggtcgggcagcggcagcggcagcggcagcaagcagccccgtcggcccgggtccggggccgttctgggccgcggcaagcaccttcgccctcccagctcgcgctgcctccctcccctcccctcctcccaggctctgcctgccaggtcggcgccgggccccgggcgcgcgcgcgcgcgccccctcgtgtgtgcgcgcgcccgccgccagctcggacccgcgcccccgcccccgccccgcgcaggacagccccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggcagcttagtgtgaaaatacaatgttaactgtttgtttctctgtgaggttagtgggaaccgcttggataagcctattgggattaatctaaatgatgtgatgatttgattcaggtatagcccaaattagtaaggggctttagctgtaaactgaaaacaatattcacaccctctcctgggcctgtaaggtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctctgggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttagaattgaggatttgttaaaatggcaagtcatttcatttgtgttaaaaagaaaatacccaaaaggaaggagggagccctgtttgccttgagataaacggccttggcattttctggcattaatgtagaaataatgttcctatgatgacatattttcaaagaaacactttcttatttactgtgtggtgtaaaatgttgctaaatgtgttgttacattatgtcactgctgaaagtaatttgcactataataaaggaattttctacaaaacaaaaaaaaaaa

SEQ ID NO: 95 - DNA, 1834 bp, Homo sapiens
  source (1)..(1834): /organism="Homo sapiens" /note="NM_018324" /mol_type="unassigned DNA"
acctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaattcttggtctattctggattctaattttttttatgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagccgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 96 - DNA, 3135 bp, Homo sapiens
  source (1)..(3135): /organism="Homo sapiens" /note="NM_006243" /mol_type="unassigned DNA"
cgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttgccttaaaaaaaa

SEQ ID NO: 97 - DNA, 8750 bp, Homo sapiens
  source (1)..(8750): /organism="Homo sapiens" /note="NM_001193451" /mol_type="unassigned DNA"
gtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtctggtttcaatctctcaagtaaaaaaaaaa

SEQ ID NO: 98 - DNA, 2594 bp, Homo sapiens
  source (1)..(2594): /organism="Homo sapiens" /note="NM_001023570" /mol_type="unassigned DNA"
cgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 99 - DNA, 3182 bp, Homo sapiens
  source (1)..(3182): /organism="Homo sapiens" /note="NM_001268" /mol_type="unassigned DNA"
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaaaaa

SEQ ID NO: 100 - DNA, 6400 bp, Homo sapiens
  source (1)..(6400): /organism="Homo sapiens" /note="NM_021982" /mol_type="unassigned DNA"
acttccggccagggcctccctccttctctctaggtttggctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaacccatgcagaccattgtttgatctatgctaacttatcaacttggctattcaataaagttaattgaaaagagcttataaaaaaaaaa

SEQ ID NO: 101 - DNA, 7785 bp, Homo sapiens
  source (1)..(7785): /organism="Homo sapiens" /note="NM_001017995" /mol_type="unassigned DNA"
agtgcgcgccgagcgaagggcggcggcggtggcggcggcggctcgtgctcggccccggctgcgattgcgctcagctccaggttccctgcccgcggcggcgcgcccccagcgctccctgcaccccgcgccacccgcacccgcgctcggcccgctgcgggcggaggagcggccatgccgccgcggcgcagcatcgtggaggtgaaggtgctagacgtgcagaagcggcgggtgcccaacaagcattatgtctacatcatccgggtcacgtggtccagcggctccaccgaggccatttaccggcgctacagcaagttttttgacctccagatgcagatgttggacaaatttcccatggaaggaggacagaaggaccccaagcagcggatcatcccctttctgccaggtaagattctcttcagacgaagccacatccgggacgtggctgtcaaacgcctgataccaattgatgaatactgtaaggccctcatccagctgcccccctacatctctcagtgtgatgaggtgctgcagttctttgagacaagacctgaggacctgaatccccccaaagaggagcacattgggaaaaagaaatctgggggtgaccaaacctcagtggaccccatggtcctggagcagtatgtggtggtagccaactaccagaagcaggagagttcggagatcagcctcagcgtggggcaggtggtggacatcatcgagaagaatgagtcaggttggtggttcgtcagcactgccgaggagcaaggctgggtccctgcaacgtgcctcgaaggccaggatggggtgcaggatgagttttctctgcagcctgaagaagaggagaagtacacagtcatctacccgtacacagctcgggaccaggatgaaatgaacctggagagaggggctgtggtggaggtcatccagaaaaacctggaaggctggtggaagatcaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagatcaccaaagatgaggcagagaccccctcctcgccgggacatgaccattcctcgaggcctcaacctgccgaagccgcccatcccgccccaagtggaggaagagtattacaccatcgccgaattccagacaaccatcccagacggcatcagcttccaggcaggcctgaaggtcgaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtcccaagacaagtccttgttggatggggagggcccccaggcagtagggggccaagacgtggccttcagccgaagcttcctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcgctttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcctttaatccttacggcaagcctgtgaggcggataggaccagccctgatctatagtgagaaaattaaggttcagagggagaaggtccaaatagtggccaagctgggactgagatctcgagtttgggtttgtttggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacatgttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccatttgacttctttcctttttttttttttaaataaaaaaagtgcttgactggtttcaagcttcatcatgaaaaaaaaaa

SEQ ID NO: 102 - DNA, 1467 bp, Homo sapiens
  source (1)..(1467): /organism="Homo sapiens" /note="NM_001130688" /mol_type="unassigned DNA"
aaaccagttcacgccggagccccgtgagggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 103 - DNA, 540 bp, Homo sapiens
  source (1)..(540): /organism="Homo sapiens" /note="ENST00000381907" /mol_type="unassigned DNA"
atggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaa

SEQ ID NO: 104 - DNA, 1849 bp, Homo sapiens
  source (1)..(1849): /organism="Homo sapiens" /note="NM_001276" /mol_type="unassigned DNA"
cacatagctcagttcccataaaagggctggtttgccgcgtcggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtgaaaaaaaaaaaa

SEQ ID NO: 105 - DNA, 5306 bp, Homo sapiens
  source (1)..(5306): /organism="Homo sapiens" /note="NM_174938" /mol_type="unassigned DNA"
ggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttctgtttttttaaaaatatttttatgtgttcaaactattttggtaaatttttagcaaaaaaaaaaaagaagcctcctggagttatttacatgtacagattgtaagactaatgcacaaaaggtatatcagaatttttttaatgttttggcgctactttgtttttaaaaatatttttggctgaacaataccataatttgttatgatctgcataggagatagaaaatgggtagaaagacactatagtaagtaagctgctaaaacagaggatggaactggaggatgtagaaactgagagcatcaagtggactcagggtggtccatttttcaaagtatttggacaagaggacttgttattttcatttgtattctgtccgtatattttggctggagaagcagatgttttaaaaagaaagtgagagtttaaaggaaaaaaggtaacagatgtgctagtcagttgcatatcaatgtacattaacccaagagtgaaggcagataggaactggagaaatggaaagtggcaaaaatgagttctggtgaggctggcaggcaaatggtgacaggcgaatggtctattttatgaaagtgatggtgatgccagcgttcgatgatgtgaagagcagtgcagtcgctgtctgagttaacatgaacatgtttaagtggatctaaataaaagtggagaaactttaaggtaaatattttgatccctcatgccatttgttgtgattctgtagaagaaacttcaaaaatgtgtttgtatgtgagtgtgcgtgtgtgtgtgtgtgagagagagagagagagagagagagagaatatgaatggctttttgatacatgtccatgatcatgttttgcggtggtcattatactcctttcctttcccagttgttttaaaatttgacttccatagagaaactggagaggcctcatgagatgacataccagttcagcctgggtaaagtagtgacatgaccctaaccagactgtagaggggaccagtgctctagtaccttccttgataccattaaatccatgatggaaaggatttaatccaacaatttaatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcaatacatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctaggtttgaaattgaaatttgtgtttttctccttcttttctcatacgacttctaagtcatcctttctgacataaggcaactttagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagatgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggtaaaaaaaaaaaaaaaaaa

SEQ ID NO: 106 - DNA, 5429 bp, Homo sapiens
  source (1)..(5429): /organism="Homo sapiens" /note="NM_018375" /mol_type="unassigned DNA"
agacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaaaaaaaa

SEQ ID NO: 107 - DNA, 1242 bp, Homo sapiens
  source (1)..(1242): /organism="Homo sapiens" /note="NM_153236" /mol_type="unassigned DNA"
agacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatctaaaaaaaaaaaaaa

SEQ ID NO: 108 - DNA, 892 bp, Homo sapiens
  source (1)..(892): /organism="Homo sapiens" /note="NM_016476" /mol_type="unassigned DNA"
gtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 109 - DNA, 902 bp, Homo sapiens
  source (1)..(902): /organism="Homo sapiens" /note="NM_019037" /mol_type="unassigned DNA"
atggcggacctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacacaaaaaaaa

SEQ ID NO: 110 - DNA, 1570 bp, Homo sapiens
  source (1)..(1570): /organism="Homo sapiens" /note="gi|13182974" /mol_type="unassigned DNA"
gcaataattaaaggatagaatggaagtgaaaaaaactttctctattatgtgttattataaacctttttataaataaattttatgatatagcagatttatgaaatgttttatatttacttaatagactttgaattaaagtactttttgtgttgctgtagttttagaatgatcattttatgcgtaacagcagggacattcaaaataagctgttaagatgtgttgtgatttgcttaaagtctgatggcaagagagaaatcataaaatttaattttatcattcatagagcagcaaatcattggtgctcagggagaatatgttatacaactcttggtcgtatattgtggtataatgttagtttaaagacactaaagtatgggaatggattgtgtatgttcagtttacatatcattttgttttcctgtttacctcctttttgttttttccttttctcctttgtgttaagggttccagcatgaggcagggaattagttagacaggaagacactagaaggaaatggagtcacgatggcccaccctatcctaaatcaagaaaaatggtactgagtagttggatgctaaattttgaaacttagactgatcctgggatttaattctgacatttgcttgccagagtttgcctttatcacacattttctacttcttgcttaacaaaacaaatacacacacacacacacacacacacacacacacacacacaccctcatgaagaactaatatttgcccatgtgatgaaagtgggggttaggacactttcactgtgtgtcattgtagcaagtatgtaagcttagacttcacctccctactttaaaaattgttcttccacttcctcttctgtagtcatgagtagcagtgcccccttgtagcccaaattctccactctagtcagccttactttcagctccaaattggatgtacttttactgaacttctttcaactttttattttgggtgctgtcacttgtactctatgtatcgatcaaatttatttttgtcagcctcaagtaatactgctctatagtagggcaacattcattgcttaaaaactatatacaaagttagtcacagaacaccatgacagatgtttgaatttttgattgaggatgttcttctgtaattatttttcaaatatcatgaataagcatataaggtatttaattcaacatttctgataaaagatttttgaaaaaattattttccaagtattttttggttttgtgctcaattcagtgtccttccaacatgtgtcagaaacccattgggccgggcgtggtggctcatgcctgtaatcccagcactttgggaggccgagtcgggtggatcacgaggtcaggagattgagaccatcctggctaacacagtgaaaccccatctctactaaaaatacaaaaaattagccaggcatggtggcgtgcgcctgtagtcccagctactcaggaggctgagccaggagaatggcgtgaacccaggaggcggatcttgtagtgagccgagatcacgccactgcactccagcctgggcgacagagcaagactctgtcttaaaaaaaaaa

SEQ ID NO: 111 - DNA, 2635 bp, Homo sapiens
  source (1)..(2635): /organism="Homo sapiens" /note="NM_198336" /mol_type="unassigned DNA"
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaa

SEQ ID NO: 112 - DNA, 315 bp, Homo sapiens
  source (1)..(315): /organism="Homo sapiens" /note="ENST00000542161" /mol_type="unassigned DNA"
atggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctga

SEQ ID NO: 113 - DNA, 5553 bp, Homo sapiens
  source (1)..(5553): /organism="Homo sapiens" /note="NM_001024630" /mol_type="unassigned DNA"
gtgtgaatgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgtta

SEQ ID NO: 114 - DNA, 1206 bp, Homo sapiens
  source (1)..(1206): /organism="Homo sapiens" /note="NM_018457" /mol_type="unassigned DNA"
tttgttgtctaatcatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcagctcaaaaaaaaaaaa

SEQ ID NO: 115 - DNA, 364 bp, Homo sapiens
  source (1)..(364): /organism="Homo sapiens" /note="NM_003546" /mol_type="unassigned DNA"
catgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctgagtgttttacttacttacacggttcctcaaaggcccttctcagggccaccca

SEQ ID NO: 116 - DNA, 586 bp, Homo sapiens
  source (1)..(586): /organism="Homo sapiens" /note="NM_002305" /mol_type="unassigned DNA"
agttaaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaa

SEQ ID NO: 117 - DNA, 2685 bp, Homo sapiens
  source (1)..(2685): /organism="Homo sapiens" /note="NM_001295" /mol_type="unassigned DNA"
ataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcattaaaaaaaaa

SEQ ID NO: 118 - DNA, 2058 bp, Homo sapiens
  source (1)..(2058): /organism="Homo sapiens" /note="NM_003596" /mol_type="unassigned DNA"
agatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaaa

SEQ ID NO: 119 - DNA, 1289 bp, Homo sapiens
  source (1)..(1289): /organism="Homo sapiens" /note="NM_019111" /mol_type="unassigned DNA"
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaaaaaaaaaaa

SEQ ID NO: 120 - DNA, 4190 bp, Homo sapiens
  source (1)..(4190): /organism="Homo sapiens" /note="NM_004244" /mol_type="unassigned DNA"
atatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcac

SEQ ID NO: 121 - DNA, 2062 bp, Homo sapiens
  source (1)..(2062): /organism="Homo sapiens" /note="NM_005306" /mol_type="unassigned DNA"
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggagcaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcctataatcccagaactttgggaggctgaggcaggtggatcacttgaggtcgggagattgagaacatcctggtcaacatgggaaaaccccgtctctactaaaaatacaaaaaaattagctgggcatggtggcacatgcctataatcccagctactctggaggctgaggcaggagaatccttgaacccgggagttggaggttgcagtgagctgagatcacgccactgcactccagcctagcgacagagcaagactccatttaaaaaaaaaaaaaaaaaaaaaaagaagcaccttcaggctggagaagcagcgtagctaacacaagtccagtccttgtgatgtggctggtagttggggatggccaggctgaagcagagagtcctagagaaatctcgatacaagcttcaaagcaacacctagacactgctctagcggttgatcctggagataaaccaacaagagagagatggaagagaaatactaaatgaggtcaaagaagactcagaaaggttctgagcctggagatgagcagggaggcctcagggcttagacctttaatgataggggtttccctgcattggtttgacctgttgcctttttgatgtgctctgtttgttttcatgtgttgtcttgtctcccctgctaaactgggagctgccaggggtctgggtcttatctccttcctccatggtaccccacacaggccaggatgtggtttggtacccagcaatcagagattggcactccctcatacaggggaaagcaacctggtctagcaaattgaaaataaagatgataaaactctgaaaaaaaaaaa

SEQ ID NO: 122 - DNA, 2173 bp, Homo sapiens
  source (1)..(2173): /organism="Homo sapiens" /note="NM_001143804" /mol_type="unassigned DNA"
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaaggg

SEQ ID NO: 123 - DNA, 2208 bp, Homo sapiens
  source (1)..(2208): /organism="Homo sapiens" /note="NM_005729" /mol_type="unassigned DNA"
gcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaaaaaaaaa

SEQ ID NO: 124 - DNA, 2282 bp, Homo sapiens
  source (1)..(2282): /organism="Homo sapiens" /note="NM_001199760" /mol_type="unassigned DNA"
gccccggtggcggaggacgtcccggaggatccctctggtcgggcgcctggctttgtgtagccagccaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaatagaagtgtgaatagtagaatattaattaaaatggaggctatcagcctgtgattttcagcttaacttcctggtgttaatgtgacaagttgatctgtctactttgcaatttaagttaaatatttatgaggaactgtgctccgactgagtgcgagaggaaggtaaacttgcgggagtgggcactgtatttcattacgcctttcatgacctggtctgtcctggcaggcacatggagacttggggactattaatttatttgttggtatttgctttggatacagaattccctaagaatattatctcacttcatcatgacttcctttacccactctagaattttatgttggacactttgtagcttttggtggttagtggagggaaaccttttatgatttaaatacttttactccactgattggttaccatcactgcatgtatcagcccttgatgagtttaagatctagtatcttataagttagaaattatttctgtttactcatggtttctgctttggaaatgaaatttgctgtgagttgaaagttggcagatggcaacacagctagggagcaataattttgttgtggggaggatttggtcatctccagaaacccgggagtcacgtggctctcttactcacactccatgtccatcctgtcaccaggtcttgttgattttgcctctgaaatgcctcttaaatctattctctcctttcaattttcctgtcactccttttgtccagccttttagcatttctaagctggactaggcgagagtgtcacacctgcttcccttggcttccatcttgcctcttccagtttatttctcaagctgcagtcaaactgatcttagaaaacacgaatctaatcatgcagcacccctgactaaggtcttccggtggctgttcagagcctcttgggtagcaaacagatggcttctgttgtatacaaagccccttaagagaggtctcctcatctactttttctagcctcttctctcccaactctgtattctcctgtaacactgactgagcactgcaggcttctgccctttgcacatagtaagcatgcatttctctctgtctgaaatgctctttctgttgttcatctagaagactgttttcccttgaagactcagccctagcatcacctcttctgtgaagtcttctgctactttcccaagcagagtgagtgttccttcccttgtctgagtggccttggccattgatgtgcttatcatgttgtcttacgtatcaaattatttgttgtcatatctgtccccttcaccatactgtgagctccaaagaaaagaagtgatctttatacttcttatgcttagtacacaactagacatatagtgtgtgtgtgagagagagaattttttaatgaaataattgaatacattggaagtgtttcattcaaaatactcatccattattctttggatagtagcataaatttgatgttttatgtacaaaagtaaaaacatttgaaaaata

SEQ ID NO: 125 - DNA, 1446 bp, Homo sapiens
  source (1)..(1446): /organism="Homo sapiens" /note="NM_015190" /mol_type="unassigned DNA"
cgaaaaagaagcagtcctgggctgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggcgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaagatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaagacatgatgattaaaaaaaaaaa

SEQ ID NO: 126 - DNA, 831 bp, Homo sapiens
  source (1)..(831): /organism="Homo sapiens" /note="NM_005564" /mol_type="unassigned DNA"
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggccaaaaaaaaa

SEQ ID NO: 127 - DNA, 1656 bp, Homo sapiens
  source (1)..(1656): /organism="Homo sapiens" /note="ENST00000233057" /mol_type="unassigned DNA"
atggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttag

SEQ ID NO: 128 - DNA, 536 bp, Homo sapiens
  source (1)..(536): /organism="Homo sapiens" /note="NM_006498" /mol_type="unassigned DNA"
gaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgagaaaaaaaaa

SEQ ID NO: 129 - DNA, 3038 bp, Homo sapiens
  source (1)..(3038): /organism="Homo sapiens" /note="NM_001199922" /mol_type="unassigned DNA"
ggagtgcccaggatggagtgcagtggctattcacaggtttaatcatagctcactaccgtcttgaatccctgggctcaagtgatcctcctgcctcagcccctgagtagctggtactaaagttaccttccacgctgtatgtccgtgagaaatacaatgaagacggtctgaataatgaactggtaatcttcgataatatgaaacgaatttaagagaacatatcaaagagaaggctctcaaaataggctgctgcaaaagctggtatattgtccggttgctctctcagaatctcgcgtgtcagcccttcaagaagattcccaaatccttgtggaattcggtagtgggtgttggagaatggaatcgacatcttcttggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactagtgatgtg

SEQ ID NO: 130 - DNA, 3715 bp, Homo sapiens
  source (1)..(3715): /organism="Homo sapiens" /note="NM_004644" /mol_type="unassigned DNA"
ccctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaa

SEQ ID NO: 131 - DNA, 17193 bp, Homo sapiens
  source (1)..(17193): /organism="Homo sapiens" /note="NM_152701" /mol_type="unassigned DNA"
gactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacaaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccaaaaaaaaa

SEQ ID NO: 132 - DNA, 2052 bp, Homo sapiens
  source (1)..(2052): /organism="Homo sapiens" /note="gi|21757933" /mol_type="unassigned DNA"
attccaggaagcgtttgcacatcctggccccagaagattttgcgtagcctcaccaagagaagaagttggaaagaaaaaaaaagaagttggcaaggcatccagaggagacccccccagcacctgggttctctgccaggggagagagttatgaagaagacttgagcaggcagtccagagctgatacagctgctccaatcaccagagatgcaatctcctgctagatgtcttcacatctacctttctatgtcacatgtgcaagatggttgctctgccttcagacatcacatttacattccaggcagaaaggagaaggaaagagcaaaagatgtgttccgaacaaatccatcttaaaaacaaacaaggggaggggtagcaggagaaaatttaaaaagaagaagaagaaaaacaaaaacaggaaagccgttgtttccctaaaagccccatcaagccgacttctaccggtgactcattacccagtcatgtggccacgcctggattcaaggcagtctgaggaggtgagtgtttcaaagaggcacatggatgccacagacaaaatcaagtttccatggttgaaggagaagaggacgatagagtttggggaggcagcaggctacgtctgccacagaagatataaagatatggagccacacgagaagatgggggaggctgccaaaaaagtccactgggtacagatgaggagcaggtgacattggagttgctccatctgaggagcccgcacctgcaatggcttgtgctcctgctcctgtgggtataggcacaaggctgatgccgagagagtgagttgtttctgttggggttcagaacacaataccccaaagtatggcgatgagtacttaactaaaggacattggaaggcctcagaagcagcctcagatccaaggtccctctgacctgctcctgccctcctgtctctctcgtccctcgttctcccctgaagtgagtcatagaaaccagaatcctcttccccacggtaggtcctagaaactagaaccctttttccccgaagcaaaagccataaaaactggaattattactctaaactctccttgactttttgtccagaagatggccataaagaaattctcagctgggtgtggtggctcgtatctgtaatcccagcactttgagaggccaaggtgggaggatcacttgaggccaggagtttgagatcggcctgggcaacatagtgagacccccatctctacaaaacttttttttttaaacttacctaagcgtggtggtacacctgtagtctcagctacttaggaggctgaggtgggagggaccctgctctggctgtgactgctttatcacagggagtgcctatctgtgggctgctttctacacattaaagcattttcagaaagggccagcatcagccttggaaaaaaggaggaagagccacggagagtctccctttatcttccccttatgtgatgtgagagtgcacatgactgtgtgcacatacacacacacacacacaccacacacacacaccccacaggcacacagggtcaagaacatgctgggcagagcttaagccactgaatgtttcagtaggaatcatgatatctaaaaataggacagctgataagggggttcttactactcacagttcctggaattatatgcaattgcatcttggaaactcaacaaataaacagttagtatggaattaaggaattaagtttggtgaagttcaaagaagctgatgttactcacaagagtaaatagagaggaaaccgggcgtggtggcttcgcgcctgtaattctagcactttggggggccaagacgagcagatcgcttgaggtagagagtttgagaccagcctggccaacatgatgaaaccctgttctctactaaaaatacaaaaattagctgggtgtggtggcgggcacctgcggtcccagctacatgggaggctgaggcaggagaatcgcttggacccaggagacaggggttgcagtgagccaagatcacaccactgcactccagcctgggcgacagagcgagactccctctcaggaaag

SEQ ID NO: 133 - DNA, 4231 bp, Homo sapiens
  source (1)..(4231): /organism="Homo sapiens" /note="NR_026586" /mol_type="unassigned DNA"
gcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccatt

SEQ ID NO: 134 - DNA, 500 bp, Homo sapiens
  source (1)..(500): /organism="Homo sapiens" /note="NM_170745" /mol_type="unassigned DNA"
gtggttctcgtgttgctgcaatttgatgcgaggagatgtctggacgagggaagcagggaggaaaagcacgcgccaagtctaagtctcgctcttctagagcgggtttgcagtttcccgtaggccggatccatcgtctgcttcgtaagggaaactatgcagagcggataggggcaggcgcaccagtgtatttggcggcagtgttagagtatctcacagcagaaatccttgagctggcaggcaatgcgtctcgcgataacaaaaaaactcgcattattccccgccacctgcagctagcgatccgcaatgatgaggaactcaataagcttttgggcggcgtgaccattgcccagggcggagtcctgcctaacattcaggcagtgctgctgcccaagaagactgagagtcaccaccataaagcccaaagcaagtaacttaaggttgtcattggtaaaaagacttctgtgtcagaaaaaacaaaaggctcttttcagagccaccta

SEQ ID NO: 135 - DNA, 478 bp, Homo sapiens
  source (1)..(478): /organism="Homo sapiens" /note="NM_003535" /mol_type="unassigned DNA"
atggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccactta

SEQ ID NO: 136 - DNA, 971 bp, Homo sapiens
  source (1)..(971): /organism="Homo sapiens" /note="NR_024610" /mol_type="unassigned DNA"
acgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaagg

SEQ ID NO: 137 - DNA, 969 bp, Homo sapiens
  source (1)..(969): /organism="Homo sapiens" /note="NM_001785" /mol_type="unassigned DNA"
caaaccatgggaggctcctctcctagaccctgcatcctgaaagctgcgtacctgagagcctgcggtctggctgcagggacacacccaaggggaggagctgcaatcgtgtctggggccccagcccaggctggccggagctcctgtttcccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaaaaaaaaaaa

SEQ ID NO: 138 - DNA, 1118 bp, Homo sapiens
  source (1)..(1118): /organism="Homo sapiens" /note="NM_003864" /mol_type="unassigned DNA"
tccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattaaaaaaaaaa

SEQ ID NO: 139 - DNA, 1267 bp, Homo sapiens
  source (1)..(1267): /organism="Homo sapiens" /note="NM_001040196" /mol_type="unassigned DNA"
ctgcgctggggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgtcccaccacaacctccagcctcccttttcagagcacagcattaaagtttggggaattctgtagaaaaaaaaa

SEQ ID NO: 140 - DNA, 1650 bp, Homo sapiens
  source (1)..(1650): /organism="Homo sapiens" /note="NM_033050" /mol_type="unassigned DNA"
gtcagaagctatatccagctgctggcagagttcctgtcaagggatcaagtcttccaacagaatggttatggtttaactcagcagaatttgttgaacaactacgacatgctggggatcatggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaattgttttggcaacattctctatgttattcttattcacatgatcctagaactttatgtgagaactgaatagcagaagatatattattaaatagtttttggaagttgtgctgttaagcaaatgtaaagtcaacagtaacaatgattaagaaaggaatataatgagttcaaagatatctatctgatatattttttatattcatcatgaatcggg

SEQ ID NO: 141 - DNA, 3304 bp, Homo sapiens
  source (1)..(3304): /organism="Homo sapiens" /note="NM_002454" /mol_type="unassigned DNA"
ggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtctcggtgattcagaatacacctacttttgcaatggggggaagataattgataaacgacttcaagagcttggagcccggcatttctatgacactggacatgcagatgactgtgtaggtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggaggaaagccaagtatctgtgacttcagcagatccagtttttcaagtgccaatttcaaaggcagttcaacttactacgaatgatgccataaaaaccactctgctggtagaattggacatttcaaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccatattcgtgtgcaagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaagatatccatctctcctcgaacaacaaattctttccacttaccagatgacccctcaatccccatcataatggtgggtccaggaaccggcatagccccgtttattgggttcctacaacatagagagaaactccaagaacaacacccagatggaaattttggagcaatgtggttgttttttggctgcaggcataaggatagggattatctattcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtggagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaaaaaa

SEQ ID NO: 142 - DNA, 1759 bp, Homo sapiens
  source (1)..(1759): /organism="Homo sapiens" /note="NM_001168357" /mol_type="unassigned DNA"
ggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattcaaaaaaaaaaaa

SEQ ID NO: 143 - DNA, 1385 bp, Homo sapiens
  source (1)..(1385): /organism="Homo sapiens" /note="NM_016108" /mol_type="unassigned DNA"
gccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 144 - DNA, 2047 bp, Homo sapiens
  source (1)..(2047): /organism="Homo sapiens" /note="NM_013363" /mol_type="unassigned DNA"
gaacaaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacagaacaaccaaaaaaaaaaaaaaaaaa

SEQ ID NO: 145 - DNA, 6118 bp, Homo sapiens
  source (1)..(6118): /organism="Homo sapiens" /note="NM_080491" /mol_type="unassigned DNA"
gcccctggcctcccgcgagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccaaaa

SEQ ID NO: 146 - DNA, 6766 bp, Homo sapiens
  source (1)..(6766): /organism="Homo sapiens" /note="NM_012262" /mol_type="unassigned DNA"
ggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatatttggaaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattggattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggccaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatctgtgtaaatcatctaactggatttttccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactactctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgtaaaaaaaaa

SEQ ID NO: 147 - DNA, 469 bp, Homo sapiens
  source (1)..(469): /organism="Homo sapiens" /note="NM_003529" /mol_type="unassigned DNA"
atggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttc

SEQ ID NO: 148 - DNA, 2159 bp, Homo sapiens
  source (1)..(2159): /organism="Homo sapiens" /note="gi|21757754" /mol_type="unassigned DNA"
agttacccctttgcaacagaacgaggccggcattttctaaagcgtccttgaggagtccagttcctaaaagattatttcagagtccactgttgtgggctgacttgaatgctctcaaaattcgtaagttgaagccctgacccccaggacctcagaacgtgactgtgcttggacacagggactttccagaggtgattaaggtgaagtgaggtcactggatggccctcctcctatctgactggtgtcctgatggggacgcggacacccacacaggaacggacccggggagaacaacacatcgtctctgcgccagggagagaggcgtccggggaacccagccgtgcccacgcatttatctccgccttccggctcagaattgtgaggaaacccgcttctgttgtgcaagtcccgggtctgtggtgctcggccatggcgcccccagaactgcatccccaccttctgctctgagccacccatcccctctggaagggctgagcttctctccctttccaccttctgttctgagccacccgtcccctccagaagggctgagcttctctctctttcactgcctatgctctgggaaactttcagaatccccaggctgtttctggaatagtctgggatggtcattttcggtcctcacagaaccgggggtttggaaagtaggtgaagccatatgggttgcagagaatctggcccagcccctcactagtccctgtgcttgttagttattctttaattacttggatatcaactctgatttaaaacatcaatttaacatacagataatgctgggactgcagcttcgccaggtggccttcctctcccggtctcgggaggcgtcacccccatcttgtccccccaagatcaagcgaaaagggcaaagttatctttttttttgcaaaattcaaacctttccctccttcccaggtctgggtcgcttgcgaccctcctctcaggctgcttctgacaggcccaagtcacagccaacttcaggggagctgtgttggatccctccaaactccgggaatgatgtgacctccccggcgctcaccctgggcctctaggttagactcagcccagaccctggctcacagggaagcagagcccatggctggcctccacccgctcagacgcccgcacacaggccaggggagggcttgggggcagctctgggagggtccctgtttgcgctgtgggtgtccaaggctgggtgtgcagagctgaggttgccacacacctgagggactctcgcataaggatggcgcggggctggaagctggactgagacagtgaatgagacagcgctgccggctctctccgcgccgtggactggctcctaggcagtctcacgagcaagtgtggtgttgctcgtgcacgtgtgttttaactgagatgtgagctggcgcgttttctccacccggctccatctgctgggtccctccacattgctgcgcgtgtgcctccagtgccatggggtccccactgtgggcagccccgcattttgcccaactgcctcccaaaccatggaaccccagtgacctccaacttgccgccatgacgagccactctcattcatatcctcaaacacggtgctctgagcccgaatgagggtttctttagagagatatctggggaccaaactgtagggacagagctcccgtctaaggtgggcctgtggtgaggtctccccagtggtacactttaatcccacagcagggcttgcaggccgccctgctccatccccaccaacactgggcaggatctagcctccaaacctttgccagtctaatagtataaaatgatagctcggtgctattttggttttgcatttccatggtgaacaatgagtttgagagtttttgttcaaaagtcctttgggagttcgagaccagactgggccaccaggagttcaagaccagcccgggcaattcagtgagatgttcatctctacaaaaaataagaaagataaaaaattagccaggcatgtttgtgtgtgcctgtggtcccagctcctcaggaggctgaggtgggaggatggcttgaccccgggaggtggaggctgcagtgagttgtgatcgtgtcagtgcacggctagcctgggcaacagagtgagaccccgtttctaaaataaaaataaaaaacaaaagagaaaagtc

SEQ ID NO: 149 - DNA, 783 bp, Homo sapiens
  source (1)..(783): /organism="Homo sapiens" /note="ENST00000443117" /mol_type="unassigned DNA"
atgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtga

SEQ ID NO: 150 - DNA, 2953 bp, Homo sapiens
  source (1)..(2953): /organism="Homo sapiens" /note="NM_030796" /mol_type="unassigned DNA"
ggggcggagcgcagccagggctgcgcggcgcgccccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaa

SEQ ID NO: 151 - DNA, 4088 bp, Homo sapiens
  source (1)..(4088): /organism="Homo sapiens" /note="NM_001135147" /mol_type="unassigned DNA"
gactccggaagagcccttttctgcagctccttggggactgcacgtctcacttctaagtttgcggcggagagaataaagcagaaagacaggaagaggaggtggagttctacagctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaagataatcaaatgggctactgatgacatcaaatctcaacttcatttactttggatatatacggcaaggtagtaatttcattatctggagtatttcacctccacatctctgcaataccagcaccttcaacagtgattggttagaggttggcatatgacatagttatgaccattgagacgtgatgctgtgtgtgctgtgaagtttctcaaaaggagtaaggaagatacagcctcttctttctagggactttgtttgtaggtgtgacacctggagcagccattttgctactgttttgtttctaattgtgttccccgccgccctccccgctcgccccgaaaaacgacatgtttgagttctaatccccagtatttcagaatgtgaccttatttggaaatagagtcattgcaaatgtaatttgttaagatgagctcatactggagtagagtgggttcctgatctagtatgactggtattcttattaaaaagagaaatttgaatactagctacaccatgtaaagatgaaggcagagatcgtggtgatgcatctacaatgtcaacaattgccagcaaatcatcagaatctgggagagaggtatggaatgaattctctctcgcagccctaagaaggaaccaatcctgtgcacacctgaatcttggacttccagcctccacaactgtgagacaatacatttttgttatttaagctacccagttgtggcactttattactgcagttctagccgactaatacagctaccttgagaggaaatagcatggggatgaaggtgatgtgctgaagaagcacagcagaaagtggaaagatggtccatgaggacatccttagccactgaattgacaagcctcttccctggagtccctcttccttgggattttttttggtgtgtgtaataatcacttttcctaatggtgcaaaccattgtgagttgctctttgactgctagtaattaaagcaaactaaccaagtcagccctccccagtgttcctttttgcaatctaaattctgatgtccaactcctccctgggccactccctgtccccagatgtctctttgtatatctaaagaagaaaaagaaggataaatcctttttctcccaagagatctccctgcttttgtgaaaagcacaaagaagggcattatctaacttttctcatcattagaagtcaagcctggccgtgactcccgttatgacattttgatggccacattttatgagaaaagcccaaacagacagacctgtctgtaaattctttcatcctttgcattctttctttgactgtaccttagagagtgtttgattattgcaggggagatggaaaagaagcaggttctggcctatgctctagttcctcactttctggagttatcttttgggcctggagtctcttggagtgaggaaaggaagccatttttatactttacttatggtagagttaaacttcgtactcttaggaggctacatgcaatctccaagaggaagagagtgaagaggttaagaattatgccatcaaaatgtgctgctctggcatattgactatttgaattacagatattttaaaaacatcagatatgaagaggtcactctgatcttaattctgtgtcttaacagcaggagatgaaattcccacatgggagatggcctccctgtcacagaaggaataccattctccctatcaatgatgagaaattggaactgagagaattctgtatagaccttgttcaagtaattcttctattttaaacctccccacataatttagctgccttttcaaaactactgtcctttgtgcaaccagtatagaagcgattgactctcactgcatccttgggtcttcttttccctatatgggctcttttcccatatgggctcttatgtcctgtaaaacatgtattaaataaatttgtatgcttttctcccgttaacctgtcttacatcaatttaattcttgggcccaggtaggaccctaagaggacagaggtcgagttttgccacctctgcaagagaaaagagagatgcccagaccaccaggcctgggaaatctttgatttcccaggctttgaagtgggcactgtgtctgaacctggccctctgaaacttcctgttcctggacatcccagctgctaatgtgagttgcccttgcactggctcagggctgggacattaaaggaatttcccttttgttgacataacagtaggatggctatagctaacaataatatattatttagtttcaagtagctagaaggaacatatgaatgttcccaacacaaagaaatgacaactatttgagatgatggatatgctaataaccttaatctgattcctatacattatatgcatcacatatacatacattatatgtataacatcactatgtaccccataaatatgtgcaattattgtcaattaaacaaataaatttaaacaaacattaaaaaaaa

SEQ ID NO: 152 - DNA, 12503 bp, Homo sapiens
  source (1)..(12503): /organism="Homo sapiens" /note="NM_002417" /mol_type="unassigned DNA"
taccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaaaaaaaa

SEQ ID NO: 153 - DNA, 3858 bp, Homo sapiens
  source (1)..(3858): /organism="Homo sapiens" /note="NM_000578" /mol_type="unassigned DNA"
acagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaaaaaaa

SEQ ID NO: 154 - DNA, 1247 bp, Homo sapiens
  source (1)..(1247): /organism="Homo sapiens" /note="NM_001657" /mol_type="unassigned DNA"
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaaaaaa

SEQ ID NO: 155 - DNA, 10510 bp, Homo sapiens
  source (1)..(10510): /organism="Homo sapiens" /note="NM_005502" /mol_type="unassigned DNA"
ggaggagggagagcacaggctttgaccgatagtaacctctgcgctcggtgcagccgaatctataaaaggaactagtcccggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaaaaaaaaa

SEQ ID NO: 156 - DNA, 6191 bp, Homo sapiens
  source (1)..(6191): /organism="Homo sapiens" /note="NM_001201427" /mol_type="unassigned DNA"
cggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctaaaaa

SEQ ID NO: 157 - DNA, 2576 bp, Homo sapiens
  source (1)..(2576): /organism="Homo sapiens" /note="NM_002343" /mol_type="unassigned DNA"
agaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaa

SEQ ID NO: 158 - DNA, 980 bp, Homo sapiens
  source (1)..(980): /organism="Homo sapiens" /note="NM_178174" /mol_type="unassigned DNA"
cagtgcccaggcaggcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagggaacaggcttggtgtctgtggccgattcctgagcagcagagtttcaggcatgaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaa

SEQ ID NO: 159 - DNA, 1012 bp, Homo sapiens
  source (1)..(1012): /organism="Homo sapiens" /note="NM_004832" /mol_type="unassigned DNA"
cccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataaaaaaaaaa

SEQ ID NO: 160 - DNA, 2494 bp, Homo sapiens
  source (1)..(2494): /organism="Homo sapiens" /note="NM_000956" /mol_type="unassigned DNA"
cggccttggccggcgcgggtaggcgcgggagcctcgagcgccgctcggatgcagcagccgagccgccactcggcgcgcggcgggagacccagggcaagccgccgtcggcgcgctgggtgcgggaagggggctctggatttcggtccctcccctttttcctctgagtctcggaacgctccggctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccttggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcagtgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactctttatttatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttgaaaaaaaaaaaaaaaaaa

SEQ ID NO: 161 - DNA, 2316 bp, Homo sapiens
  source (1)..(2316): /organism="Homo sapiens" /note="NM_001816" /mol_type="unassigned DNA"
agcacaaaaggaggaaggacagcacagctgacagccgtgctcagaaagtttctggatcccaggctcatctccacagaggagaacacgcaggcagcagagaccatggggcccatctcagccccttcctgcagatggcgcatcccctggcaggggctcctgctcacagcctcacttttcaccttctggaacccgcccaccactgctcagctcactattgaagctgtgccatccaatgctgcagaggggaaggaggttcttctacttgtccacaatctgccccaggaccctcgtggctacaactggtacaaaggggaaacagtggatgccaaccgtcgaattataggatatgtaatatcaaatcaacagattaccccagggcctgcatacagcaatcgagagacaatataccccaatgcatccctgctgatgcggaacgtcaccagaaatgacacaggatcctacaccctacaagtcataaagctaaatcttatgagtgaagaagtaactggccagttcagcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagatttttttttttttttttttgagatggaatctcgctctgtcgcccaggctggagtgcagtggcacgatctcaactcactgcaagctccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatcaaaaaaaaaaaaaa

SEQ ID NO: 162 - DNA, 1284 bp, Homo sapiens
  source (1)..(1284): /organism="Homo sapiens" /note="NM_016184" /mol_type="unassigned DNA"
ctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctcaaa

SEQ ID NO: 163 - DNA, 1738 bp, Homo sapiens
  source (1)..(1738): /organism="Homo sapiens" /note="NR_002217" /mol_type="unassigned DNA"
gtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgt

SEQ ID NO: 164 - DNA, 469 bp, Homo sapiens
  source (1)..(469): /organism="Homo sapiens" /note="NM_001193374" /mol_type="unassigned DNA"
gtgtgccggatttggttagctgagcccaccgagagggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatg

SEQ ID NO: 165 - DNA, 6091 bp, Homo sapiens
  source (1)..(6091): /organism="Homo sapiens" /note="NM_000922" /mol_type="unassigned DNA"
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaaa

SEQ ID NO: 166 - DNA, 3909 bp, Homo sapiens
  source (1)..(3909): /organism="Homo sapiens" /note="NM_018837" /mol_type="unassigned DNA"
gagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggaaaaaaaaaaa

SEQ ID NO: 167 - DNA, 2805 bp, Homo sapiens
  source (1)..(2805): /organism="Homo sapiens" /note="NM_001145001" /mol_type="unassigned DNA"
gggcgggcgcgcgggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaaaaaaa

SEQ ID NO: 168 - DNA, 1744 bp, Homo sapiens
  source (1)..(1744): /organism="Homo sapiens" /note="NM_022145" /mol_type="unassigned DNA"
gcagaagtccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctctaaaaaaaaaaaaaa

SEQ ID NO: 169 - DNA, 7784 bp, Homo sapiens
  source (1)..(7784): /organism="Homo sapiens" /note="NM_145725" /mol_type="unassigned DNA"
gggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaaaaaa

SEQ ID NO: 170 - DNA, 4522 bp, Homo sapiens
  source (1)..(4522): /organism="Homo sapiens" /note="NM_003608" /mol_type="unassigned DNA"
cctgtcccctcagcagtgttggtttctcttcttgacttgatgcaggcacagatttatcaagctcctcagtcaacaaacacatcaccggaagaaatatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgtattgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacctggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaatattttcttaatgactcagggtctttattgttaatgccaattgtttttgtatctgtgctataatcccttagagtcagtaaagtatgtaggggactgtttcttcctttgtgtctgggtttatgatttttctcactctttctttggactccagggtgtcagccatcaggtctcctaattttgtgtaccggtctccaacaaccccagctactgaatactgcttctaatctcctcattcattaacaaatctttatttttttatcttgtataaaataactgctttattgacacaaaatttacataacttaaaattcaactttgtattgtgtacaattcagtgattttttgtatattcacagagctgtgcaaccatcaccacactcaaaaaattttcatcacccaccaaagaaatcttatactcttagcagtcgctccctgctctcccgtccatgccagttattaatttactttctgtctctaaggattttcattactctgaacatttcatataaatagaattatacaatatgtggcctactgtgacgtatttcacttagtataatggtttcaagttttatccatgtgtagaatgtatcagcacttcatttctttttatggcctgatagtattctgttgcatggttatactccattttgtttatctaatcacttggcttcattaacaaatatttattgaatccattccataaactaggttttgagttaagtactggggctatgaaagaaatggtctcatgaagcctcacgaagtttacattagttcaaaagcctagtcaccgagcttgaaagatttctatataaaggaaaaggaaataggctctgagttttattttgatctctttttaatttataactgggtataacatagctgaaattaccagaagtttaatgcatagacaaataaatagttctattatatctttctttttggacttagaatgttagaatattttgagagttctttttttttttttttttgagtcagagtcttgctctgtaatccaggctagagtgtagtggtgcgatctccactcactgcagcctccacctcccaggttcaagcgattctcctgcctcagcctcccaagtagctgggattacaggcacccaccaccatgcccagctaatttttgtatttttagtagagacggggtttcaccatgttgcacaggctggtctcaatcgaactcctgacctcaagtgatcatcccacctaggtctcccaaagtgctgagatgacaggcgtgagccaccatgcctggcaaagagagtcttgatacaacatattcttttgaatcctcattgtgtaaattgcctcgttgtaaatagacactcagtaaacattttcctcaccaaaatatttttaaggatttttctacccttctccttttctctttgctttccttttcttgcctgttctttccactccccccaaaatgatcagatagcaaatgtcttgataacatgaggtgccctcacattaaaaaacaaaatattgagccgggcgcggtggctcatgcctgtaatcccagcactttgggaggctgaggtgggcagatcgccttaggtcaggagttggagaccaggctgaccaatatgatgaaactctgtctctactaaaaattcaaaaatgtgccagacctggcctggtggcatgtgcctgtaatcccagctacttgggaggctgagtcataagcctgcaatgggaaaatggatcgaatctggggtgagggggaagtgatgtgggggttatggtacctcttttctcttccaaagatgctgttcttactgcatcacttgtggctggccaggaaaagccatgcaggagttttgtttgtggccactaggtgacgatcgtgttctgtacgggacctcttattaatagttcaccactagccgccactccagaagagcggaggaacccaggataatattttgtcaaccaagaaacaagaagtccctcccaggaactggaaatgaatggggaaaatgctgaaatctcatttgcactattcatttctcttctctctggaaagctcggcaatcatcaggtcatttcatttggcttaaattccatgtgtctttccaaacttttaaaagctggtgaaaattgttccacccatatgtaaaagaacataggttaagttgtctaattcttgcaggaatgtggatatagcattaaaaatatgtctttgtatacttatcttacccatgtaagaaaagagtggccaactttcatataaatagaaagagaacatttaagctatatgcagtttgcatttttgtctactattatgaaattattatctatgaaattcaagctgtaactcaacatatgtataattttaatttctaatttattgttagatctcagcacttaaaaaattacatcttgtatttgaattgttaaatctgttccctgcaaagaacagtaatacaatcatgttctaatttactagcatttgcatattttagaaatataatggcctgtaatttacttttcttttgcctataattttctgaagctctttatgatgcaccggtgcatttttatttaaaaaatagattgtgactcctcaaataatgttacaattcgatgttcaaaaagcaatccaggtacatagccataaagggatgagctagagaggtctccatattatcattcaatgtgagaataaaaattctatattttattctagaataaaattataaatttctttatcta

SEQ ID NO: 171 - DNA, 5463 bp, Homo sapiens
  source (1)..(5463): /organism="Homo sapiens" /note="NR_046000" /mol_type="unassigned DNA"
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtacttaggagtttagcttaagtcgtcatatataaaatacagtctctaatatcatgattgatggagagcattcagcttgccttagatgctgtaaattcaggaaaagctgaacattaaggcgtttttgttttttggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttaaaaaa

SEQ ID NO: 172 - DNA, 2179 bp, Homo sapiens
  source (1)..(2179): /organism="Homo sapiens" /note="gi|42521648" /mol_type="unassigned DNA"
gtgagactctgtctctaaaaaataaaaattaaaaaaaaaaaaattaaggaaaaaggacagaaaatccaggcactggctgtgcagtggagctaacagctaagtttgatgttatgatgggttatgtgtgaatgatgttagtgcctgcctggtccttctcatcctgatggaccaacatgcattttattttgttttctgtttctttaaaatttagtatcttctatttatttttttctgttcccaatgtgcaccctttttgttcctttttcaattgttcctgtccttccctttggatttccgtttcacagacttcacttcagttctctcgctgttatgacaaaccctggttggtaaacagtaaagctggcacccctatcagggacagccattctcctgacctccagctgcccacccccgaggtagagtatggctttgctgactgaggacacagtcaagacgaggccctcgctactggacttgaccagctcttcttcctgacacgaatccctgcactctttcatctctgtggtgcttgctgtcacagctgattcatctagtccagtgttttcaggggtttctaactcggattcaccaaaattggagagaaataagagatgcctgaaactagattaataactttataacaatcttgagaatgatatttgctgagaatggtaaatgatggtcattgctgtagatttgtttattgatgtcatttataatcaggcctcttggaatctccaaatgtcagatactcagacgagttatgaacacttgaaattcaactatggcgcatgttctacaatgttctgtctttgcttagaacagaagagtggttggcgccacctgccctgagacacatgtccagggtggttggtattgccacaccacactggtccgaggcgtgggtgctgtctccttcagccaagcacagcaccagtgaacactgacctgaggctcacattctagcttctgaatttcttggcctaggcacttgagtttctgtagccttgatttgaatacacatgccagcaattaagcatgttcaagtgcagccattaaagtgcctgaacgcttttggaagagcagtgttttagaaataaaacatggactagtggcttgtctgatagtagtgcagtttgcattccagctcctaccaagaaacattggattcttgtgcctcaagacagtgttgccttcagtcttggaaagccttagccagggaaacaagggatgcacaagaagtcaatggctatgaatgagctgctgttttgaggttcatttcacttcaagctaaaactccagttcagaaatatatctggtttagaatatgatctggggacctactgccactaaactactagactcaccctgcttatcttgcttttcttctttccttaatggctccagtttcataaaaatctcagttctattttaaattttagatgtttaatgatgtacaaattctcatacagttctgataaatcagggcttttgttctgtcttaaggttttattttctgtttcatttcattttgaggcttcatctttccttacttattggtgttctgtagccaggccatctcctgacttggaattctagcccgggttctagctgtggtcttccagcagcagtgcgcaggaaccttagcttctgaaactggtgttcttcctcctatgtggccaggaaattttgtgcttgagtgttaatcactttctatcgcttatgctttttctttataaatttaagaagtacagcaaacaatgagatggattgcttttctcttctgtttgcataaacgtcttaaaggtcctggaaaacaatttacataattgatttcaaagaaaaattagaatggcatgctgtagcatgtggcataagtaatgttttgggggtttttttgtttgtttgtttgtttgttttttcattttttaaaaagcgaagtagagacaaggtcaaataatggatgtttaaaacatttaaggatcagcctggtcaacatggcaaaaccccatctctactaaaaatacagaattagctgggtgtggtggcaggcgcctgttgtcccagctacatgggaggctgaggcaggagatcacttgaacctgggaggcagaggttgcagtgagccaagattgtgccactgcactccagcctgggcaacagagtgagactgcctcaa

SEQ ID NO: 173 - DNA, 3611 bp, Homo sapiens
  source (1)..(3611): /organism="Homo sapiens" /note="NM_001144" /mol_type="unassigned DNA"
ctcttccgcgccggcaggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactctaaaaaaaaaaaa

SEQ ID NO: 174 - DNA, 971 bp, Homo sapiens
  source (1)..(971): /organism="Homo sapiens" /note="NM_000985" /mol_type="unassigned DNA"
cctgcctcctcagatctcgtttcttcggctacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaa

SEQ ID NO: 175 - DNA, 7006 bp, Homo sapiens
  source (1)..(7006): /organism="Homo sapiens" /note="M_003749" /mol_type="unassigned DNA"
cggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaaaaaaaaaa

SEQ ID NO: 176 - DNA, 3508 bp, Homo sapiens
  source (1)..(3508): /organism="Homo sapiens" /note="NM_002230" /mol_type="unassigned DNA"
tgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 177 - DNA, 2194 bp, Homo sapiens
  source (1)..(2194): /organism="Homo sapiens" /note="NM_013230" /mol_type="unassigned DNA"
gggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaaaaaaa

SEQ ID NO: 178 - DNA, 4463 bp, Homo sapiens
  source (1)..(4463): /organism="Homo sapiens" /note="NM_004481" /mol_type="unassigned DNA"
ccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttttaatcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccgctaaaa

SEQ ID NO: 179 - DNA, 2549 bp, Homo sapiens
  source (1)..(2549): /organism="Homo sapiens" /note="NM_007355" /mol_type="unassigned DNA"
ctccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgttttaaaaaaaaaaa

SEQ ID NO: 180 - DNA, 3593 bp, Homo sapiens
  source (1)..(3593): /organism="Homo sapiens" /note="NM_024656" /mol_type="unassigned DNA"
acgcgtggcgcgatggcggcggccccacgcgcgggccggcggcgcgggcagccgctcctggcgctgctgcttctgctgctggcgccactgccgccgggggccccgccgggcgccgacgcctactttcccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttcacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcggacaacatccccccaccacccaagagggagggtagctcttccgccaccaggggcaagcacaggtcctggtggccccacgccacatgttagcccccctggagggggcgccagttggagacgggggctgggtgtccctggcccactcccagtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttc

SEQ ID NO: 181 - DNA, 933 bp, Homo sapiens
  source (1)..(933): /organism="Homo sapiens" /note="NM_001001658" /mol_type="unassigned DNA"
atgatggacaaccactctagtgccactgaattccaccttctaggcttccctgggtcccaaggactacaccacattctttttgctatattctttttcttctatttagtgacattaatgggaaacacggtcatcattgtgattgtctgtgtggataaacgtctgcagtcccccatgtatttcttcctcagccacctctctaccctggagatcctggtcacaaccataattgtccccatgatgctttggggattgctcttcctgggatgcagacagtatctttctctacatgtatcgctcaacttttcctgtgggaccatggagtttgcattacttggagtgatggctgtggaccgttatgtggctgtgtgtaaccctttgaggtacaacatcattatgaacagcagtacctgtatttgggtggtaatagtgtcatgggtgtttggatttctttctgaaatctggcccatctatgccacatttcagtttaccttccgcaaatcaaattcattagaccatttttactgtgaccgagggcaattgctcaaactgtcctgcgataacactcttctcacagagtttatccttttcttaatggctgtttttattctcattggttctttgatccctacgattgtctcctacacctacattatctccaccatcctcaagatcccgtcagcctctggccggaggaaagccttctccacttttgcctcccacttcacctgtgttgtgattggctatggcagctgcttgtttctctacgtgaaacccaagcaaacacagggagttgagtacaataagatagtttccctgttggtttctgtgttaacccccttcctgaatcctttcatctttactcttcggaatgacaaagtcaaagaggccctccgagatgggatgaaacgctgctgtcaactcctgaaagattag

SEQ ID NO: 182 - DNA, 825 bp, Homo sapiens
  source (1)..(825): /organism="Homo sapiens" /note="NM_001178135" /mol_type="unassigned DNA"
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatgg

SEQ ID NO: 183 - DNA, 1767 bp, Homo sapiens
  source (1)..(1767): /organism="Homo sapiens" /note="NM_001141945" /mol_type="unassigned DNA"
ctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaaaaaaaa

SEQ ID NO: 184 - DNA, 3191 bp, Homo sapiens
  source (1)..(3191): /organism="Homo sapiens" /note="NM_152282" /mol_type="unassigned DNA"
gggaggagctggcggcgagcgccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactataaaaaaaaaaa

SEQ ID NO: 185 - DNA, 4109 bp, Homo sapiens
  source (1)..(4109): /organism="Homo sapiens" /note="NM_001137550" /mol_type="unassigned DNA"
cgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcagcaatgtggttctaatttttttccactgagaaagaagatctttaatttcatattaatggttctgtatattttgggtcatctttttattttttaagaatatcaagtcaattcatttttctttccctatttaaaaaaaaaggtgttttcacagaatgagtgcacttaaaaagtgaagtgaaggaggaggtaacagtagagacgatggcaatatcatcaaggacaaaagtaaaaacgtttagctacctgctgatttttagtgactgttcatatatgttgtatttcaagtatggctggtgaagccagtcagcttttcgggacgttagcaagtggaaactgagtcagtatcatccaaaaccatatctagtcttaacacatggagaatgctggagtgagggttgtgagttcagggtatataatcaagaaaacactcccagcataatgctaggggtcaccagtgtccatcccccagaactgtatggatctaggatatacacagctgcgttgcattaagaaagagatgaaatctctattaaaatacacaagatttttgtatctccttgtgcagaggatatttgccactgcccattgggaagcagacaagttatagggggctgggggccaacactggcaagtaggaaaccacgggtcggacaggtgagcaaaatgtgctggcaggtgggcaccactgggagacccacactgcacacccgggcaccgtatgaacaggaaagaggaaggaagctggacgaagcccctcagggaccctgtgctgaccatgctgggcccaccggcaaaagggagatattcagttccttgtctcatccttaaggtttcttccacaacatctgaatacaagcatgtttaactgggaaaatgtctatgtcatgcgtgaataacaccagcagcaaacactcacacatcacgcagacacggccggcagcatgctgacgcttttaggtatttttcactcatgcaattttcacatattttcactcatttcatttgcacggaaattctatgaggtagatgctgttatcaaatccacattacagatgagggacccagggtccaggaaggtgaactggcagaagtctcccagctggtagaacagggctgcaaggcatcgattcccaggtgtctcacagccctgagaagatggcgttttccctatcagtggctctgaggaagtcaagccttcagtctctacctctcccaccaattcttttggaaacagcaaaccaatgttacacacacttcctaatccagaggaagctagaacacgatttttaaatttatttagtaaaataaaactttttttgcagatgtaacgaaaaaaaaa

SEQ ID NO: 186 - DNA, 6294 bp, Homo sapiens
  source (1)..(6294): /organism="Homo sapiens" /note="NM_001161352" /mol_type="unassigned DNA"
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttaaaaaaaaaaaaaaaaaa

SEQ ID NO: 187 - DNA, 510 bp, Homo sapiens
  source (1)..(510): /organism="Homo sapiens" /note="gi|12584148" /mol_type="unassigned DNA"
tttttctcatcaaggtgctgtgagcatttggcagggtaattcttcactatgtgggtctgtttctagaatagcaagcattcagcatccctgagcctggcatttgaaatgccagtagcaccctccaatcattgtgacaatcagtgtccccacatattttcaaaagctcttgtggtaagtgttgccccttcccctccccgtgacaaacctgccccttatacctttactgatgtttctagcctatgtggcctacaaaaaaagtgtgaagggggaaaagctatgttgttcacattaaaaagagataggttttcatttctgctttttgtaagccattgctgaagttaaatttaattgcaaaatactaaactcttgaaccaattctaggacaggtttgcagaatgattttcttaaaggacctttataatctattaccctgaaatgaatttctgagacttaacattcgtaacactagggcatgattaaatatatgggagcaagattgggaacattttg

SEQ ID NO: 188 - DNA, 6082 bp, Homo sapiens
  source (1)..(6082): /organism="Homo sapiens" /note="NM_000885" /mol_type="unassigned DNA"
ataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatctgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaa

SEQ ID NO: 189 - DNA, 4431 bp, Homo sapiens
  source (1)..(4431): /organism="Homo sapiens" /note="NM_001412" /mol_type="unassigned DNA"
gagtcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgta

SEQ ID NO: 190 - DNA, 4248 bp, Homo sapiens
  source (1)..(4248): /organism="Homo sapiens" /note="NM_176818" /mol_type="unassigned DNA"
ggcgttacgcgcgggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagtcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaacgta

SEQ ID NO: 191 - DNA, 4065 bp, Homo sapiens
  source (1)..(4065): /organism="Homo sapiens" /note="NM_206831" /mol_type="unassigned DNA"
cttgcccggcgcgacctgatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagaaatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatccatttgcttttatgtagtttttcttctaaatgtcaacattttgaattaaaatgtttatgattttatatgaggtagaaatcttaactgctttggggtattgttaatagactttttgttatggacagtagtttttaaataaggaaattgccaatttctacagtttgggctctggatttctattgtttgggaaaaaaataactgagtcaagtggtagtaagacaaagttgacattcttagatgagtaactcagtttattacaaggaaagaaaactgattgtttaaggctgatgatcaattcttggagtggtttcagagcccagctctggtcagaagacaatttgaatcttagttcctccactgtgatctccgagaagttacttaataattatattctggtttgtgaaatctggatcatagtacctctttgacagggttgctgtgtgaacccattcattctgcaattagaaaaatagctgtcatgtgctatgcactaggcaaagaagtacctgtcacatgctaggcactaggggaagaagattcggtttctacatttggaaacttagtggaactagaagagacagaagcaagattacagatgagttagagcccccaaggaaacaaaccaggtgatgtgggagagagtaactgggtcaggtgactttttaagggagtctgagctctggcactttttctaagacctgaaggatgagaaggaaacagccttgtgaaaatgattaaatgagctagtatctataaaacatgacagctaatgcctgtcatgtgcaaaaaatggttaactattctaactccgaaaggaattaaacattgttttgcgctttctcctagtccatgttctgctgctgtaacaatacctgagactggataatttatcaagaataaaggttaatttggctcatga

SEQ ID NO: 192 - DNA, 2943 bp, Homo sapiens
  source (1)..(2943): /organism="Homo sapiens" /note="NM_001031711" /mol_type="unassigned DNA"
gggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaataaaaaaaa

SEQ ID NO: 193 - DNA, 1893 bp, Homo sapiens
  source (1)..(1893): /organism="Homo sapiens" /note="NM_007261" /mol_type="unassigned DNA"
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 194 - DNA, 967 bp, Homo sapiens
  source (1)..(967): /organism="Homo sapiens" /note="NM_001085386" /mol_type="unassigned DNA"
gacaattcctgtttacggaagactataaaaccctgccccctactcatttggtgctgacgccattttaggccttagcctgcctgcacccaggcgctcattaaaacagcaggttgctccacactgcctcgtgttgtctgttggcacactctcaagagtttgaacggatacaagaatctttcatctggtgccgaaacccgggaggggctccggtcttcgtcccccgtggacctacccctccgccccagaaagcaggccacagcagccggacaaaggaagctcctcagcctccagttgcttctctgtgcatgcacatcagtcactgatctcacctactggggccctgcaggccatggggccacagctccacacagaagcctcctagcaatccacctccacctggtgcctgcttcaagtgcggcaatgaaggccactggcccacacaatgcccaaacccaggtaaacccacgaggccatgccccctctgcggaggaccccactggaagttggactgtgagcggcccctgcaaggaccacccccatcccttcctgagccaatcaaaccctcctactcggatctcgtcagccttgccgctgaagactgatagtgccttggaacagacaccccagcaactaccatcgcttcatctgagccaagggtaaccctgatggtggcaggcccagtcccaaggcgcaaggccacttgtgccagcagtgtgagtcagcaagatagcagaagcaggaagagagccggccagaagacacctactctgactgggagacacgtacccctgaagattgagaaagaggccatccaggtaccacatagcagttacatcagactgggacatttcctgtttacaggagactataaaacccctgccccctactcatttggtgctgacgccattttaggcctcagcctgcctgcacccaggtactcattaaaacagcgtgttgctccaaaaaa

SEQ ID NO: 195 - DNA, 2906 bp, Homo sapiens
  source (1)..(2906): /organism="Homo sapiens" /note="NM_004897" /mol_type="unassigned DNA"
gatgtaagagtcatctgtaaaagctgtgctgttttggcagcctgggaggctaaggtttagtctaggcgactaaggtttagtccgggctgtattcacacccaaaacaactaaaaaagcggaggagtctttgagtcaatccctgaagctccggctaagaggaaactcgcccacgctccagggcagcgacgccggctccacctcagccacggctgtctcaagcttctcggggttttccgccggctccacccgagccacaagtctacaggactcctcggagctttccgccgggacgcaagacccaccgccagaggttggtacctcctagagaacagcgaagcgcatcccgagggccgccggccggaagcgccctccagacccgccccctgccctccggagccggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcaaaaaaaaaa

SEQ ID NO: 196 - DNA, 1946 bp, Homo sapiens
  source (1)..(1946): /organism="Homo sapiens" /note="NM_003141" /mol_type="unassigned DNA"
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgaaaaaaaaaaaaaaaaa

SEQ ID NO: 197 - DNA, 4608 bp, Homo sapiens
  source (1)..(4608): /organism="Homo sapiens" /note="NM_006969" /mol_type="unassigned DNA"
aggcctggtttctgtcctgcgcgcgcagattcgcgcagaccaggaagcggatcccgtggaatgacggtcacgccgcggcgggcggattgacttctaaagaatcttggtacgtgaggaagaaacccagaagaggaagaggaaagcaaaggagtcagggatggctcttcctcagggtctattgacattcagggacgtggccatagaattctctcaggaggagtggaaatgcctggaccctgctcagaggactctttacagggatgtgatgctggagaattataggaacctggtctccctggatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaaaacaacccttgcacgtcatcatagaattcatactgcagagaaactttacaaataggaagaatgtgacaaagttttcggttgcaaatcaaaccttgaaacacataagaaaatgcatgctgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcagtatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgattttcttcacagatcatgtcatctacaaacaaataaaatttgacttctttctttctgaaaaaaaaaaaaaaa

SEQ ID NO: 198 - DNA, 2425 bp, Homo sapiens
  source (1)..(2425): /organism="Homo sapiens" /note="gi|21538810" /mol_type="unassigned DNA"
gagggaatcagaattgtgtttcaagagcgtcactatacggttaggatggaagacagattagaggaaatgcgagtggataaggcaagatgcatttggaagacagtcaagagtttaaccagaaagagaagacatgtcagtaattgccatcatgggaagcagtgagaagcaccagaattgagaaaccaagtactttaagagttagaggagggagacacaccctgtctagctgaggttcatggaagagttggtattcaactgggagggattttatcagtagaggagctgagattgagaatggggttgaggaagagataagtcaggagcaaaaatacggaagtgagggagcctgtgactgaagagcaacatgtagatcaatttgatgaaagcactaggtaggggccagcaaatactggtttgcttctgttttccagagaacctcgaggagacaaggtagaaaaccaatcccagatgaacaggagtactactgagacctgtactgaataagacaagagaaactcagtgagctaaactagggtataagccacttgcaggagcagagcagggtcaggcattggtctgacttgctgtgaagaccttaagctgtgaactcataggacttggattccacttgtcagggagtttgattggttcagaatctggggcaggatggaacctgcaggaaaaagctgactggccccgtgtgagacaggtgacactggaggaatgaagaataggcaccctcagaggtttaggctggaggcttggtgagaatatcaaccctgacccatagagctactgaaatgtatgatactacagtgagcgccaaggataccttcccagccaaacatgccaaggaatagtctggggatggctagtgaaccaagcttcacaggtagccccagttcttcatgagagacacacttgagttgctggcaataatattcttactgtccaaggcttaagtggccctatgtctcacaaggccccattcagggcttatcaagcctcttgaatattccatcaagttagtctgaaactctagagtatttactttatatgttctgaacttaacagggcacattctgtctctaatatcttggttctgagtacccatcctcactaggacactagtgccatcttgctagctggtccatgagttacataatgatggagcatctcatatgtgtagttctgtaacagtgaccaagcagtggacattcctatccattcaaggctgaacatgtgatggagcaaggcatgtctgcacagggcctagcatgaaggggttgaacccttataacttggaaactaactgaatgggagaaatgagatggaataaggcactgacgttggtgcaatttctgattatattttgttgccatttaacttgtttttactgtatgccacaccctgtggtaactcgtttcatctgcacagtgacccttgaaatgcccacagtatagacgagaaaactgaactccttagaattgacgtatcttgcccaaggtcatacaatgagtgaatggggcaacctggacatggacttcagtcttcctgagctcagagctgaccaaagactctgtctaaacttccaagacccttttctcccattggttgatgcacatggtattgaaaaatgtcgagcattctctttctctgttgaaaagttctgcctcccattagttatgaagggaatcctacagaaaggggtgagtcccttaaattcttcaactgattatgggaggttagcaaaaaaaagagagtttatgaacccatgaaaccttaggttctatgtatcagctgtgtcttactgaaatcacctcttgaaccaggacccttcagacatagcaattcatgtcctcagtctccggacacaatggaatcctcattataaggccttccacacaaagataataatagtggtgcctctcccatgtgtgttcacatttttgagaaaaaatattcttgcagctatcaaagcacctgctaatcaaagatttcctattccctgtaatttgtttttaatcttgtaaagccgactactttcaaataggactcatagtgtcaaaggctgaaattcatttccttgaacttcatttaaactgggccacagaatcattctgagagaatcatttaaattaatatgtggcattacggtgttaaaaagaaaaaaattttgtcctaattcccaatttcagagtttctccagacctccaatctgggctctgaccccataattgtgtgcagctgagctgctgacaagtccacacatattctgaagtcacattttctggctctggggctccaaggactcacaaagaggaggaatttttttttttttaatccctgcttgttccgtcaactagttcaccggttaaaccctgattgaatgtagaaattttagaaatgaaaaaaaaaaaaaaaa

SEQ ID NO: 199 - DNA, 1385 bp, Homo sapiens
  source (1)..(1385): /organism="Homo sapiens" /note="gi|15530286" /mol_type="unassigned DNA"
ggggttaacatgcggatcctgttagtagatctgggatgggttgagagtctgcctttctaacaggcttttgggtgatgtcgatgctgctggtccagggaccatacctctactcagaaggcctaacactgtatgccactttggtgtgacaagatgaaacactttgagcttcctcaggatcttcctttcccatttgcccagatgttcttcctctggatcttttctgttttttgtattttttgttttttatttttctttgagacaggtcttactctgtcacccaggctgcagtgcagtggcatgatcacagctcactgtagccttgacctcctgggctcaagccatcctcccacctcagcctcctgagtagctgggactacaggcgcacaccaccacacctggctaatttttcatttttttgtagagatgaggtctcactatattgcccaggctggtctcaaactcctgggctcaagtgatcctcctaccttggcctaccacagtgctaggattacaggtgtgagccaccgcgcccagacttcctctagatctttactcggctgtcttcctttcattcctatctcagcaaaaacgtcaccacctagagaaactttgttttctcccatggcccaaatctaaagtagctcccactgcctgttttagctcttagaagacagcctctgagatgatcttgttttgtatttctctctgtctctatgagaagaggagttctgcgagaacaaagcccttgcacttgtctgtctctgtccagtgctgtttcttcctcccacccttggccgagcctagcaggatgcctagcacatagtaggtactcaaattgtgttgagaagaaggtcgcaattcctatctccaagggtcccactgactagaatgagagatggaaaagtcagtaactagttataactgtggtgttgaaaagcagtgtgagaaggagtagaccccaggctgtctgggttctaatccatgtaactctaaaatcgcttgtgcctcagttttctcattaaaatgaggtgaagtaacagtacctttcttatacatctgttgtgaggattaaatctaataaatgtaaagcctgagcaaagtacctggtatagagtggaccatcaggaaatgttagttgtgatgaagaggatgatgaagatgatgaaatggtggtggtggggatggttatggtgatagttgcagggggagagcctaacttttcagggagggcttcacatacgaagtgcactttgagctgaatttccaaaggcaagtagtaatgccttagggcagtgtcttagttaccattgctgttttattagtctgatcttacactgctataaagaactacctgagactgggtaatttatgaaaaaaaaaaaaaa

SEQ ID NO: 200 - DNA, 1592 bp, Homo sapiens
  source (1)..(1592): /organism="Homo sapiens" /note="gi|7021995" /mol_type="unassigned DNA"
ttctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaaaatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatct

SEQ ID NO: 201 - DNA, 3249 bp, Homo sapiens
  source (1)..(3249): /organism="Homo sapiens" /note="NM_000201" /mol_type="unassigned DNA"
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgccaaa

SEQ ID NO: 202 - DNA, 577 bp, Homo sapiens
  source (1)..(577): /organism="Homo sapiens" /note="NM_005645" /mol_type="unassigned DNA"
gtgtaaccagctgggagccagccggcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgatt

SEQ ID NO: 203 - DNA, 2860 bp, Homo sapiens
  source (1)..(2860): /organism="Homo sapiens" /note="NM_000917" /mol_type="unassigned DNA"
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 204 - DNA, 3080 bp, Homo sapiens
  source (1)..(3080): /organism="Homo sapiens" /note="NM_207445" /mol_type="unassigned DNA"
tccttcagcaggatgtacacagagatataactttctacagcatccactgcagctctgggctccatttccctttgaaatgggatgggagaaaggggcaggtaacagactggagtgaggagactgaggagaaactgtagagaataatacttaggagtacacgtgctggattctctcattaaggaaatattcatgagtcaactatccagaatcatagttattattcaagcggtgtgggtttaaaaggagatttgatgccatggcaaacctcactgacttagactgttcttcaagttaaagagcaggatgatgtctgaagtggctgaaacacatatggcttcagtgtgtcaagaagacctgaaagatcccacatggaagtgaaattcattactggcaagcacggtggcaggagaccccagagggctgagccgcaaagaatttgcagagccttatggctaactccatggcctagtttgatcttgaagttactgtcttggataatcctctcaaatctgttcctgcacttaagagccactcatcacatgacggagctccctctcaggttcctttacatcgccctgtcagaaatgactttcagggaacagacatcacatcaaatcatccaacagatgtccctttcaaataagttggagcagaaccaactatatggagaagtcataaacaaagaaacagacaacccagtgatttccagcggattgacattactctttgcacagaaacctcagtctcctgggtggaagaacatgagttcaacaaagcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtatttcactataggaaaactaatatctaactgagctccaagtgctaaataacagcatctcatgttcattccgggtcaccaagaggttcagggtgaccaagtcacaaactataaatttgaacatttgatgatttttgcaggagactgggtgaacaaaggaaaacccgagagatacataaaggtggaaactaggatttctcatttgaattatttaacatgcctcactctaatggttataaatgtaaaggaaatgcaggttcttcaagaaggtgaaacgaagttactgaatttaagtttttttttttttaaacctactttagaataggaaacatgcttactaatatttacaaggcactacaaggcaccagccaaaaagcctgatttattggcaggatattcttgttgttgttgtttctattgtccatataggcaggcaattaatactttttagaaaattaagttgccaactcaacactgcctacttttgaatttttattctagcaacagccgataatttattggaaattccttatgtgctgggcactacgctagacattgggagtacgaaaattaatatggtaaagatcctggctttaaagagtctttaacattatttcagcagttttattacaggtgtatatgttggaattgacagaacacttagctcaaagcaagggttcaagcatgactttgcagagtagatttcagctgagcttaaaggatgtgagaataagtatacacattttttaaattacccagaatgtagtgcctacagaagtgcttgagcctcagttgcttctaagagtccaacttcagaacttgtatcttctagattgagctcattgcttaatttctagccaacatagcccatctctctcagctgaatactaagctcatcaacttctcctttgatctaggtcttgattagaatgttgaacatgacaaggctgaaggcagaaaccatagaaacttctatccagagttacactcgtctcttaatagctgcctactgttgcaatcagaataaactcacttcttgcccaattatgacagttcattcaccttctactcaagggagactttaagaattgttgaagttgaacttctcaggttcttatacttagtgacactgttcatgcaatggctcagtatttcttgatttctcagaaccagcaaaagtcacaaactgaatcctcaaattggaattcgtaagtgactaacttgtagcataactttattatactaggaaagatggggcaagggacagaaaaaatatctgtaacatcttatatgttcaaatataagcgctttatgtatatttagtcattcaaactccaaatacacattaagaagtagtcatcaatattccactctctaattctacaatttctacctttttagattccacatataagtgagatcatatggtatttgtcgctctgtgcctgacttatcttacttaacataatgtccttaggttcatccctgtttgaaaatggcagaattgcctgtttttttttttaaggctaaatagtatcctattttgtatattcagcacattttaaaaaatctgttcatcagctgacggacacttaggttgattccttatcttggctcttgtgaataatgctgcaatgaacacaggagctcaaacatccctttgaaatactgatttaaatatctttgggtataaacccggaattggctgtggggagttagacagggaaaatgtccacattgctctacggatacaaagtttcagttaggaggaataattctggtgttctattgcacagcacagtgtctatagttaatagtaatgtattatatatttcaaaatagctaaacaaagagaattttaatgttcttaccgcaacgaaataattgtttcagaaaataaatatgctaattagcctgatttgctcattccacagtgtatatacatgtatcaaaaagtcacattgtaccccataaatatacaaaattatttgtcaattacaataaaacttttttttaaaaagt

SEQ ID NO: 205 - DNA, 3927 bp, Homo sapiens
  source (1)..(3927): /organism="Homo sapiens" /note="NM_002108" /mol_type="unassigned DNA"
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgccaaaaaaaaaaaaaa

SEQ ID NO: 206 - DNA, 7728 bp, Homo sapiens
  source (1)..(7728): /organism="Homo sapiens" /note="NM_015990" /mol_type="unassigned DNA"
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaaaaaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaatgaataatagagaaaataaatgttagagaggatgtggagaaattgaaaaccttcattcgttgttggtgggaatgttaaatggtgtagccactgtggaaaacagtttggcagttcctcaataagttaaaaaaaagaattaccatatgacccagcaagtccactcctgggcatatactgaaaagaactgaaaacaggtgttcaagcaaaaactttcacgcaaatattcattgcagcactagtcacagtagccaaaaaagaggaaacaacccaaatggccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtgaaaaaaaaaaa

SEQ ID NO: 207 - DNA, 2768 bp, Homo sapiens
  source (1)..(2768): /organism="Homo sapiens" /note="NR_002612" /mol_type="unassigned DNA"
ggagctttgctgaaactgcacaaaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctaggcctactctaggtgcggtacttcactatagtttataaaagatggtccctgtcagcaaagaactgtaacctgtatgagaatattatactaacatacaagaaacaagtagagaataatggaatgtaaactctggcttgctaacttaagtgtggtagaagcttgaaggaaatgtggacttaaacttatcagagaagacttataagaggatatgaaaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgggatgtggagacgctggtagcggggccaggaaggctccggacggagcaggttttctggaccacagacacactgccccggcgccctccgcaggccgctcctccccaggcccatgacagtgccccgctggtttctgccgcgctgccggactggagctcagacggccttcgccagcccccccaacccacgcagatccctgctgacctgggcaactccccaccctcgctgaaggttcgaggaccaccccgctttcccgagaggagccgggcggcgggtacttatctccgacctccggctagtgggaaaggccgcgcgaccgcccgtcctccaactacagggaccgcacgaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaaacttctaaaaatttgctgttgagaccagctgaaatgtttgaaagaagcaactaaagaaagaaactttgaaagaagcttccaaaagaagcaaccaagtctacaaaggcacagtttgactcaaatggatccaactgattagcaaatggaaaataacatggaggaatatattttgcatgacaagcatagcagctccaagtcatccctaatgaagccaaaaatttaagtgcaacccagagaatggatggttcagaatcttttttttttttgagatggagtctcgctctgtcacctaggctggagtgcggtggcatgatctcggctcactgcaagctccgcctcctgggttcacgccattctcctgcctcagccttccgggtagctgggactacaggtgcctgccaccacgcccggctaattttttgtatttttagtagagacggggtttcaccgtgttagctaggatggtctcaatctcctgacctcgtgatctgcccgcctcagcctcccaaagtgctggaattacaggcgtgagccaccgcgcccggcccagaatcttttttaaattttttattattattattttttctgagatggagtccggctctgtggccaggctggagtgcagtggcacaatctcagctcactgcaacctctgactcccaggtacaagtgattctcctgcctcagcctcctgagtagctgggataacaggcacgtgccaccacgcccagctaatttttgtatttttagtagagacggggtttcaccatgttggccaggatggtctcgatctgcctaccttggcctcccaatgtactgggattacaggcgtgagccaccgtacccggcccagaatctttgccttttgtttgcatagtttaatcttctaaaccagttgctttcccagaaaaggtgacttaaagtcatagcctttgtgttcatcaccatactctccatagttttacaaattattcagtttatttttaaaaggggtaatttttaaaatttttatttttaattccgaagcattccttttaatacattctcttgagggaaaaaaaaaatcacacatagtgattgtgtgtggtagtgattatgtgtggcctaagtggcaattgatcaataccccaatctcaagcctgtacattgttactggttgactggttggttgcctggtgggctttttgtccttccagatgtttttctaccttctgccttttccaataaagcttccattat

SEQ ID NO: 208 - DNA, 6339 bp, Homo sapiens
  source (1)..(6339): /organism="Homo sapiens" /note="NM_015199" /mol_type="unassigned DNA"
ggtcttctcagcgcagtcggccgcggacccgctggtcccgggcagcggccaaggctactggggcgggagcagtgggccggtcggcggcggcagcggcagcggcggaggaggaggaggctggagtgggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 209 - DNA, 606 bp, Homo sapiens
  source (1)..(606): /organism="Homo sapiens" /note="ENST00000375864" /mol_type="unassigned DNA"
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctga

SEQ ID NO: 210 - DNA, 1719 bp, Homo sapiens
  source (1)..(1719): /organism="Homo sapiens" /note="ENST00000344062" /mol_type="unassigned DNA"
atgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccgtccccatccacagctgtgaggttcagcccacacactgcggccaggacagcaggagaaggaaggttgtggggcttggggtccccagagatggccaccagcacggcccaatgcccaggggcaactacctagaggctgactcccagctcaagttgcgagtggacatcgcggtgccactgagggccggggccagagctgctgatcctgaccttgggggctcccagtttggccgcatcatcttcgtctttgactttaagaaggtctccctgctccacagcctgctgcaggacatcaccatgatcaacgctaaggccctcggcctggactcctaccctgtcaggaccctgcagcagatcctgtcagccttcaaggtgcgtgtgcgggtccaggagcagcagcacctggatgtgctcactggcttccacctgctggacgggaagacacaccttttcatcctggaaggcctggccgaccaaggcttgaggcagctgtgggagaaccaccaaagctggattcccaggtcagaacacaggaaatacaaggtgctgtacaactcacagctgctgttccgcagccggctctatggggacctggaggccatcctgtaccacgtgcacctcttccagcccacggagctgctgctgcagcaggcggtgttcttcctgcgagacactgagcggaggcgggtcttccaggctctagccaggatccacgacatctgctataacagcaccaccctctgggacgtgacggtgagggacctgctgccctcctctgctatgataaaagacttgagccaagagtttgggatgcccctttcgcaagaagaactcacagatgagaaactgtttgccctaccacctcagcctgcccccaatcttgaggactaccacagtcggaactccaccctcaccttagagatccacgcccaccaggagccaagaaagagattcacgtactcacaggattacctctcagccatggtggagcccctggacttgaaggaagaggagaagaaagcccagaagaaatcccgccaggcctggctcacagccaggggattccaagtgacaggtcttcagagcgacaccgaaagcagctttcaggatctcaagctgccacccatcaaagagctgaatgaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacagtcaggaagaagaaagggaacagccccatctcctga

SEQ ID NO: 211 - DNA, 1528 bp, Homo sapiens
  source (1)..(1528): /organism="Homo sapiens" /note="NM_004528" /mol_type="unassigned DNA"
cgcccttacagcagagcgcctaaaaccgctacggtggctctgctggggacaaattattcacgtcccactgttctgcaaacccaatccgggaggtatgacctggctgggacagtttaggaagatggccacgaaggcacctgggggagtagatatatgtttttgagaatgagaggagtaaatcgctggacgaccatgagcaggaagaaaattaggcctccacctcccaaccagtggccctgagttggcaacttagacagcgcgcgccagcgccaggagccccgccttgggggcgtggccgcgcgctggtcggctggggcggggcctgcttctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaactcctgactcttaccactcatttccgtttgagtctgtatctgaaatcagtagcctagtcctactagatgagaaaggagccacaagtattgtgccctctcctcacccttccagcagatgcttctgtagtatgtgaggttgagaaaaagtctgattgtggtgatgtaggtatagtcatgccacagtgatgaaaaattaaagaaaaatcttctagctctcaggatatgcattatcacttgctacagatactccaaggccaaaggaatgcttgagcctaaaagttcaagaccagcctgggcaacatagcaaaaccccatctctacaaaaaaatatacaacagttagccaggcatgatggcacatgtctgcagtcccagctacttgggaggctaaggtgggaggatcacttgagcccagggtgtcaaggctgcagtgagttatgatcacactgctgcactccagcgtgggtgacagagcaagaccctgtctcaaataaataaaaattaagtttctattaaaaaaaaaaaa

SEQ ID NO: 212 - DNA, 4564 bp, Homo sapiens
  source (1)..(4564): /organism="Homo sapiens" /note="NM_015187" /mol_type="unassigned DNA"
agtggcggcggcggcgggtccggaggtggcggcaggtggccccgcgcgcggcggccggcccggccgggggcgggcgggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgactaccaaaaaaaaaaaaaaaa

SEQ ID NO: 213 - DNA, 914 bp, Homo sapiens
  source (1)..(914): /organism="Homo sapiens" /note="NM_001540" /mol_type="unassigned DNA"
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcaaaaaaaaaaaaaaaaaa

SEQ ID NO: 214 - DNA, 1657 bp, Homo sapiens
  source (1)..(1657): /organism="Homo sapiens" /note="NM_005508" /mol_type="unassigned DNA"
gctcacaggaagccacgcacccttgaaaggcaccgggtccttcttagcatcgtgcttcctgagcaagcctggcattgcctcacagaccttcctcagagccgctttcagaaaagcaagctgcttctggttgggcccagacctgccttgaggagcctgtagagttaaaaaatgaaccccacggatatagcagacaccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcaattgtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatctccatgatgctctgtagaaaaatgaaatggtgaaatgcagagtcaatgaactttccacattcagagcttacttaaaattgtattttagtaagagattcctgagccagtgtcaggaggaaggcttacacccacagtggaaagacagcttctcatcctgcaggcagctttttctctcccactagacaagtccagcctggcaagggttcacctgggctgaggcatccttcctcacaccaggcttgcctgcaggcatgagtcagtctgatgagaactctgagcagtgcttgaatgaagttgtaggtaatattgcaaggcaaagactattcccttctaacctgaactgatgggtttctccagagggaattgcagagtactggctgatggagtaaatcgctaccttttgctgtggcaaatgggccctct

SEQ ID NO: 215 - DNA, 1596 bp, Homo sapiens
  source (1)..(1596): /organism="Homo sapiens" /note="NM_001071" /mol_type="unassigned DNA"
cgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtcaaaaaaaaaaaaa

SEQ ID NO: 216 - DNA, 3048 bp, Homo sapiens
  source (1)..(3048): /organism="Homo sapiens" /note="ENST00000536831" /mol_type="unassigned DNA"
atggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctga

SEQ ID NO: 217 - DNA, 3624 bp, Homo sapiens
  source (1)..(3624): /organism="Homo sapiens" /note="NM_176816" /mol_type="unassigned DNA"
cagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacaaaaaaaaa

SEQ ID NO: 218 - DNA, 446 bp, Homo sapiens
  source (1)..(446): /organism="Homo sapiens" /note="NM_003521" /mol_type="unassigned DNA"
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtgagcctctcgctgcagtaacagttccgccgtgacccacaccccaaaggctcttttcagagccgtcca

SEQ ID NO: 219 - DNA, 3710 bp, Homo sapiens
  source (1)..(3710): /organism="Homo sapiens" /note="NM_002612" /mol_type="unassigned DNA"
aggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaa

SEQ ID NO: 220 - DNA, 3142 bp, Homo sapiens
  source (1)..(3142): /organism="Homo sapiens" /note="NM_207627" /mol_type="unassigned DNA"
agacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtggcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaaaaaaaaaaaaaaaaaaaaaaaaa

SEQ ID NO: 221 - DNA, 1498 bp, Homo sapiens
  source (1)..(1498): /organism="Homo sapiens" /note="NM_000576" /mol_type="unassigned DNA"
accaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaag

SEQ ID NO: 222 - DNA, 5809 bp, Homo sapiens
  source (1)..(5809): /organism="Homo sapiens" /note="NM_003246" /mol_type="unassigned DNA"
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttataaaaaaaaaaaaaaaaaaaa

SEQ ID NO: 223 - DNA, 3334 bp, Homo sapiens
  source (1)..(3334): /organism="Homo sapiens" /note="NM_000419" /mol_type="unassigned DNA"
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctg

SEQ ID NO: 224 - DNA, 2180 bp, Homo sapiens
  source (1)..(2180): /organism="Homo sapiens" /note="NM_005780" /mol_type="unassigned DNA"
aggaggcggtgcgtgcctcgcctgccaaagggagatccgctcctctgcgtgcgatccccggcgcccgcgcgcgcccacagcgctccgccagagctgccgccgcggactcgccgggagtgggggtctccgctggtgccagcccgcttctggagaccctccgcctcctgccaacccctgctcttccaggtcgggccccggggttctgcggctgttagggacagaggcaaagaagggcaggacggtccggtttcccgtggatgttcccgcccgagaaagacagcaagttgtgtgtgcgcccgggacgcgggagggaaggtagccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaaaaaaaaaaaaaaa

SEQ ID NO: 225 - DNA, 2816 bp, Homo sapiens
  source (1)..(2816): /organism="Homo sapiens" /note="NM_002287" /mol_type="unassigned DNA"
attctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccc

SEQ ID NO: 226 - DNA, 472 bp, Homo sapiens
  source (1)..(472): /organism="Homo sapiens" /note="NM_003537" /mol_type="unassigned DNA"
atggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccactt

SEQ ID NO: 227 - DNA, 2014 bp, Homo sapiens
  source (1)..(2014): /organism="Homo sapiens" /note="gi|29387167" /mol_type="unassigned DNA"
taaacttaccttgtcatgtgtttgaagctgtggcttgccaggatcagtttattaggacatttgttttttattttatctaacaaattaccctctagtgtgctcctctttagtttttttctgagaaatttcccatttatgtctttttaaatttaaccagagcaaactggactttaatcacaaaacttccaagaggtcaaaaccatgtgaaaagttgattgctttggccttttcatgagttagcataccagctgtaggtttccatgtcacattcctaccaagtctctgatctgttgtatgattttccctttgtcttcatattcctccaaaagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctactttcaccttaaaagatccatctaagtctcagatctggaaacgttttgtaccgattatccacagcaaaacaaaaataagcttttattttattaataatttcgttcctcttgtgcccaatcaaatcttttaggaacaaactgcaagaaaagctaagaatgttttagagtgaactaaatacagacattgcttacttgttttgaagagggttttggttttggttattgtgtctttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttttgcatgttggttaattgtggccattctttaatttaaagttaaaactataatcttaggtagaaaaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacgcgcgcacacacacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaaaaaaaaaaaaaaaaaaa

SEQ ID NO: 228 - DNA, 273 bp, Homo sapiens
  source (1)..(273): /organism="Homo sapiens" /note="ENST00000525158" /mol_type="unassigned DNA"
atggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatga

SEQ ID NO: 229 - DNA, 4310 bp, Homo sapiens
  source (1)..(4310): /organism="Homo sapiens" /note="NM_207647" /mol_type="unassigned DNA"
ggcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcaaaaaaaaaaaaaaa

SEQ ID NO: 230 - DNA, 439 bp, Homo sapiens
  source (1)..(439): /organism="Homo sapiens" /note="NM_021066" /mol_type="unassigned DNA"
atgtctgggcgtggtaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctgctgccaaagaaaactgagagccaccacaagactaagtaaagaccgagttgaaaagcgcataaaaacaaaggctcttttcagagccacttca

SEQ ID NO: 231 - DNA, 1800 bp, Homo sapiens
  source (1)..(1800): /organism="Homo sapiens" /note="ENST00000362012" /mol_type="unassigned DNA"
atgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctga

SEQ ID NO: 232 - DNA, 839 bp, Homo sapiens
  source (1)..(839): /organism="Homo sapiens" /note="gi|14250459" /mol_type="unassigned DNA"
gaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactaaaaaaaaaaaaaaa

SEQ ID NO: 233 - DNA, 2206 bp, Homo sapiens
  source (1)..(2206): /organism="Homo sapiens" /note="NM_080678" /mol_type="unassigned DNA"
ttttttttttaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttcatttgctgcctgcctaacactctcaaacttaactgccagcttccttagacctctggattcccccatctgccatctactgggtttagtttgtttttcttaatttatagaatctctgattgtgagatcagtctgtcacggagacccagcaggtgaggaatgtaggccttgcttcctctttgcacccatta

SEQ ID NO: 234 - DNA, 3255 bp, Homo sapiens
  source (1)..(3255): /organism="Homo sapiens" /note="NM_001104595" /mol_type="unassigned DNA"
gagaaattctcagcctcggggaagagtatttcttgatgagggaagagcgcggggaagacactcacgcacgcacaaacatgtgggcggccatggtgtgcccagcgccgtgctggcttctgggaacccccagtggacaagacggacaaggtaccggctctcaggggaagtgggagccagtcacaagcgtacctaatttcggagagtgacaagtactctgaaaaagaaagaaggtagggctggtgactggccaatttaagcgggcaggagtctgctgggggacggagaccagcctcaggtctgggttggggacagaagctgtgcctaagtgtggtgcaggatgcagttgcaaaggagcgcttccgatcgcacttgatgctcgccacgtccctgcaaagtgctcccgccccctttctgcaaatgaggaaacgggacgcgcggctcgccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaaaaaaaaaaaaaaaaa

SEQ ID NO: 235 - DNA, 459 bp, Homo sapiens
  source (1)..(459): /organism="Homo sapiens" /note="NM_003531" /mol_type="unassigned DNA"
atggctcgtacgaagcaaacagctcgcaagtctaccggcggcaaagctccgcgcaagcagcttgctactaaagcagcccgtaagagcgctccggccaccggtggcgtgaagaaacctcatcgctaccgcccgggcaccgtggccttgcgcgaaatccgtcgctaccagaagtccaccgagctgctgatccggaagctgccgttccagcgcctggtgcgagaaatcgcccaggacttcaaaaccgacctgcgtttccagagctctgcggtgatggcgctgcaggaggcttgtgaggcctacctggtgggactcttcgaagacaccaatctgtgcgctattcacgctaaacgcgtcaccatcatgcccaaagatatccagctggcacgtcgcatccgtggggaaagggcataagtctgcccgtttcttcctcattgaaaaggctcttttcagagccactca

SEQ ID NO: 236 - DNA, 1745 bp, Homo sapiens
  source (1)..(1745): /organism="Homo sapiens" /note="NM_003965" /mol_type="unassigned DNA"
gaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaaaaaaaaaaaaaaaaa

SEQ ID NO: 237 - DNA, 3444 bp, Homo sapiens
  source (1)..(3444): /organism="Homo sapiens" /note="NR_003094" /mol_type="unassigned DNA"
agaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 238 - DNA, 983 bp, Homo sapiens
  source (1)..(983): /organism="Homo sapiens" /note="NM_198275" /mol_type="unassigned DNA"
ggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcaccataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaagtctcataagagactcatgacttcccctttcaatgaattatgctgtaattgaatgaagaaattcttttcctgagca

SEQ ID NO: 239 - DNA, 2580 bp, Homo sapiens
  source (1)..(2580): /organism="Homo sapiens" /note="M_080725" /mol_type="unassigned DNA"
ggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaa

SEQ ID NO: 240 - DNA, 1561 bp, Homo sapiens
  source (1)..(1561): /organism="Homo sapiens" /note="NM_004357" /mol_type="unassigned DNA"
attctcagcgctgggagccgccgcccccgcagctgctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatggaaaaaaaaaaaaa

SEQ ID NO: 241 - DNA, 473 bp, Homo sapiens
  source (1)..(473): /organism="Homo sapiens" /note="NM_003536" /mol_type="unassigned DNA"
ctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccaccca

SEQ ID NO: 242 - DNA, 670 bp, Homo sapiens
  source (1)..(670): /organism="Homo sapiens" /note="NM_031919" /mol_type="unassigned DNA"
ctttcaccctggcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttgataaaaaaaaaa

SEQ ID NO: 243 - DNA, 2814 bp, Homo sapiens
  source (1)..(2814): /organism="Homo sapiens" /note="NM_001131065" /mol_type="unassigned DNA"
tgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacgttttaaaaaaaaaaaaaaa

SEQ ID NO: 244 - DNA, 3675 bp, Homo sapiens
  source (1)..(3675): /organism="Homo sapiens" /note="NM_012112" /mol_type="unassigned DNA"
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctcaaaaaaaaaaaaa

SEQ ID NO: 245 - DNA, 1135 bp, Homo sapiens
  source (1)..(1135): /organism="Homo sapiens" /note="NM_006272" /mol_type="unassigned DNA"
gggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 246 - DNA, 6946 bp, Homo sapiens
  source (1)..(6946): /organism="Homo sapiens" /note="NM_032828" /mol_type="unassigned DNA"
tttccacgtgtgcacgtaacgtaaggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacaggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggccaatattgtgaattcctgtctctactaaaaatacaaaaattagtcgggcatggtggcgggtgcctgtagtcccagctactcgggaggctgaggccagaaaatcggttgaacctgggaggtggaaggtgcactgagccaatatcacaccagtgcactccaacctggtgacagagagacacatcatctcaaaaaaaaaaaaaaaactcaatccataaatgttatactttataactttataacagcatgttatatgggcttagatattatccctaaatttttttttttttttttttttttgagacagagtctcactctgtcacccaggctgaagtgcaatggcatggtctcggctcactgcaacctccgcctcccaggttcaagtgattctcttgcctcagcctcccgagtagctgggcctataggttccctccaccacgcccagctaatttttgtatttttagtagagatgggctttcactacgttagccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcaaaaaaaaaa

SEQ ID NO: 247 - DNA, 2120 bp, Homo sapiens
  source (1)..(2120): /organism="Homo sapiens" /note="NM_152501" /mol_type="unassigned DNA"
aaagcagagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatctggttgaaatactatatatatatatatatatatatatatatatatatatatatatatataccagctattaattctaggaaatggagtattaagggtgcattttatttcattagttttacttttatgcattttcttcatatcatattttgcattcagaattttcataatttgaaaaaaaataaacttttttttcttaaagagtgaaaaaaaaaaaaaaaaaaaaaaaaaaa

SEQ ID NO: 248 - DNA, 7043 bp, Homo sapiens
  source (1)..(7043): /organism="Homo sapiens" /note="NM_020775" /mol_type="unassigned DNA"
agagaggaggcggttgtcaaggcgacgtgggtaggaggagaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccgtcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaaaccccgtctctactaaaaatacaaaaaattagccgggcgtggtggcgggtgcctgtagtcccagctactcgggaggctgaggcgggagaatagcgtgaacctggaaggcggagcttgcagtgagccgagatcgcgccactgcactccatccagcctgggtgacagagtgagactctgcctcaaaaaaaaaaaaaaaaaaaaagaaaagcacaaagagaggcaacaaggaatgtttttgtttttgagacaggctctcactctgtcacctaggctggagtgcagtggcataatcactgttcagtgcagcctcaagctcttgggctcaagctatcctcccatctcaacctctcaagtagctaggactacaagtgtgcaccaccaggctcactaatttttatattttttgtagacacagggtttcaccatgttgcccaggctggtctccaactcctgggctcaagtgatctgtccgcctcagcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctgttgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattacacaattcacctttaaaacatacgattcaatggttttcagcaaactcacagagttgtccgcccacttgagagcaaacacatgttcaattttcttttcctttttttttttgagacagagtcagctttgttgcccaggctggagtgcagtgccatgatcttggctcactgcagcctccccatcctgggttcaagtgatccttctgcttcagcctccccagtagctgggattacaagcatgcgccaccacgcctagctaatttttgtgtttttagtagagatggggtttcaccatgttggccaggctggtctcaaactcctggactcaagtgatccacccacctcggcctcccaaagtgctgggattacaggtgtaagccaccgtgcctggcctacatgttcaattttctatgaacaaaggctttagtccttgacccagggctaaagtggtctgtccaagctgttgttggtagagggagtatgataaaatgtttaaatctcatttggttaccttgagtcctggaacatgcagtaactgtcatgctatagacatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcactttttttttttgtaaaataaaaacataccttacaaaaaaaaaaaaa

SEQ ID NO: 249 - DNA, 2631 bp, Homo sapiens
  source (1)..(2631): /organism="Homo sapiens" /note="NM_002483" /mol_type="unassigned DNA"
gaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 250 - DNA, 4752 bp, Homo sapiens
  source (1)..(4752): /organism="Homo sapiens" /note="NM_001130415" /mol_type="unassigned DNA"
agtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaaaaaaaaaaaaaaaa

SEQ ID NO: 251 - DNA, 2271 bp, Homo sapiens
  source (1)..(2271): /organism="Homo sapiens" /note="NM_000134" /mol_type="unassigned DNA"
ttctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagctgacaattacacaagaaggaaataaattcacagtcaaagaatcaagcacttttcgaaacattgaagttgtttttgaacttggtgtcacctttaattacaatctagcagacggaactgaactcagggggacctggagccttgagggaaataaacttattggaaaattcaaacggacagacaatggaaacgaactgaatactgtccgagaaattataggtgatgaactagtccagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagactgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaagctgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatctaaaaaaaaaaaaaaaaaaaaaaa

SEQ ID NO: 252 - DNA, 6704 bp, Homo sapiens
  source (1)..(6704): /organism="Homo sapiens" /note="NM_001080424" /mol_type="unassigned DNA"
ggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcct

SEQ ID NO: 253 - DNA, 351 bp, Homo sapiens
  source (1)..(351): /organism="Homo sapiens" /note="ENST00000390265" /mol_type="unassigned DNA"
atggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccct

SEQ ID NO: 254 - DNA, 1215 bp, Homo sapiens
  source (1)..(1215): /organism="Homo sapiens" /note="NM_006097" /mol_type="unassigned DNA"
gcccccgcctggagtccagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgctaaaaaaaaaaaaaaaaaa

SEQ ID NO: 255 - DNA, 481 bp, Homo sapiens
  source (1)..(481): /organism="Homo sapiens" /note="NM_021058" /mol_type="unassigned DNA"
cacgctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtgagttggttgcaaactctcaaccctaacggctcttttaagagccaccca

SEQ ID NO: 256 - DNA, 1020 bp, Homo sapiens
  source (1)..(1020): /organism="Homo sapiens" /note="NM_138327" /mol_type="unassigned DNA"
atgatgcccttttgccacaatataattaatatttcctgtgtgaaaaacaactggtcaaatgatgtccgtgcttccctgtacagtttaatggtgctcataattctgaccacactcgttggcaatctgatagttattgtttctatatcacacttcaaacaacttcataccccaacaaattggctcattcattccatggccactgtggactttcttctggggtgtctggtcatgccttacagtatggtgagatctgctgagcactgttggtattttggagaagtcttctgtaaaattcacacaagcaccgacattatgctgagctcagcctccattttccatttgtctttcatctccattgaccgctactatgctgtgtgtgatccactgagatataaagccaagatgaatatcttggttatttgtgtgatgatcttcattagttggagtgtccctgctgtttttgcatttggaatgatctttctggagctaaacttcaaaggcgctgaagagatatattacaaacatgttcactgcagaggaggttgctctgtcttctttagcaaaatatctggggtactgacctttatgacttctttttatatacctggatctattatgttatgtgtctattacagaatatatcttatcgctaaagaacaggcaagattaattagtgatgccaatcagaagctccaaattggattggaaatgaaaaatggaatttcacaaagcaaagaaaggaaagctgtgaagacattggggattgtgatgggagttttcctaatatgctggtgccctttctttatctgtacagtcatggacccttttcttcactacattattccacctactttgaatgatgtattgatttggtttggctacttgaactctacatttaatccaatggtttatgcatttttctatccttggtttagaaaagcactgaagatgatgctgtttggtaaaattttccaaaaagattcatccaggtgtaaattatttttggaattgagttcatag

SEQ ID NO: 257 - DNA, 649 bp, Homo sapiens
  source (1)..(649): /organism="Homo sapiens" /note="NM_001828" /mol_type="unassigned DNA"
catttaaattctgcagctcagagattcacacagaagtctggacacaattcagaagagccacccagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcacaaaaaaaaaaaaaaaaa

SEQ ID NO: 258 - DNA, 2988 bp, Homo sapiens
  source (1)..(2988): /organism="Homo sapiens" /note="NM_001199208" /mol_type="unassigned DNA"
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgccca

SEQ ID NO: 259 - DNA, 4427 bp, Homo sapiens
  source (1)..(4427): /organism="Homo sapiens" /note="NM_024548" /mol_type="unassigned DNA"
gcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccaggtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttaaaaaaaaaaaaaaaa

SEQ ID NO: 260 - DNA, 8412 bp, Homo sapiens
  source (1)..(8412): /organism="Homo sapiens" /note="NM_138927" /mol_type="unassigned DNA"
ggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttat

SEQ ID NO: 261 - DNA, 3567 bp, Homo sapiens
  source (1)..(3567): /organism="Homo sapiens" /note="NM_002198" /mol_type="unassigned DNA"
agagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcaaaaaaaaaaaaaa

SEQ ID NO: 262 - DNA, 21882 bp, Homo sapiens
  source (1)..(21882): /organism="Homo sapiens" /note="NM_182914" /mol_type="unassigned DNA"
gtttgccgctttccgagcgccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactgaaaaaaa

SEQ ID NO: 263 - DNA, 5643 bp, Homo sapiens
  source (1)..(5643): /organism="Homo sapiens" /note="NM_000902" /mol_type="unassigned DNA"
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 264 - DNA, 1817 bp, Homo sapiens
  source (1)..(1817): /organism="Homo sapiens" /note="NM_024552" /mol_type="unassigned DNA"
aagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 265 - DNA, 542 bp, Homo sapiens
  source (1)..(542): /organism="Homo sapiens" /note="NM_001925" /mol_type="unassigned DNA"
gtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaag

SEQ ID NO: 266 - DNA, 5339 bp, Homo sapiens
  source (1)..(5339): /organism="Homo sapiens" /note="NM_024913" /mol_type="unassigned DNA"
gcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattgtgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggctttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggtttgtcttttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaataaaaaaaaaaaaaaaaaaaa

SEQ ID NO: 267 - DNA, 126 bp, Homo sapiens
  source (1)..(126): /organism="Homo sapiens" /note="ENST00000549649" /mol_type="unassigned DNA"
atgtgcgaccgaaaggccgtgatcaaaaatgcggacatgtcggaagagatgcaacaggactcggtggagtgcgctactcaggcgctggagaaatacaacatagagaaggacattgcggctcatatc

SEQ ID NO: 268 - DNA, 678 bp, Homo sapiens
  source (1)..(678): /organism="Homo sapiens" /note="gi|38532374" /mol_type="unassigned DNA"
tttcagagacagggtcttgctatgttgcccaggctggactcaaactcctgggctcaagcgattcttccgccccagcctcctgagtggctgagactacaggtgtgtgccactgtgcccagcaagattttaaaaaatacgtatgcccggacaccactctaaaccaactaaatgagaatcagatatcgtgaagtcactaatcattttgctcctgggtctttatgacagttttgctcctgggaaactcctgggaatgtggtagagagagagaaagagatgggaaaataagattttaagaagtgttgctatgcattttgaaaataatttttatttggtgtttgtcttgagggaaggcggtaaacatttcaattgcctttaagtgtgcttggatgctggaacgatggttctttgaatgcagcgtcaaactggcattgggtcacatggcagccagcattaacctttatgccacatttataaaacatgaatgtcatgagcccactctcagagaccttataatttggagggttaggtcagatccacaaatctcttctatctcatggtaaaggaaacctggcgtgtagcaggagatggtgtgataacaataacatatcgcatgatcagtatttgtattcttcttagcaatattaaactttttgacctcctcaaaaaaaaaaaaaaaaa

SEQ ID NO: 269 - DNA, 3215 bp, Homo sapiens
  source (1)..(3215): /organism="Homo sapiens" /note="NM_000250" /mol_type="unassigned DNA"
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 270 - DNA, 6683 bp, Homo sapiens
  source (1)..(6683): /organism="Homo sapiens" /note="NM_001874" /mol_type="unassigned DNA"
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggtcaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaaaaaaaaaaaaaaaa

SEQ ID NO: 271 - DNA, 12204 bp, Homo sapiens
  source (1)..(12204): /organism="Homo sapiens" /note="NM_173485" /mol_type="unassigned DNA"
gtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactgaaattttcgtgtatttttccccttgtaagatgttcaaatgctaacttcattttctcctttcctctatgtggcactttctcaaaatatctatgaaatacttttagacaaagattgagctggagaaagagatacaaatttccatccccccagacagagagacatatttccattgtaggaaggcattaaacattttgaaacttgtgaatcatctttagaatttctactggggaattttacttcttcatccaaagtaaaagccacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaaaaaaaaactaaccactccattcaactctctcagaaaataaatttcaatgtgttcaatgaattgtcttgaacctgaaacctgcatttagatatcagtcccctgccaatagctaatattaacagaatttgaacaatcatacaattatgtctcaaatgtgaagactttgtacagtaatattttcactttctaaatgacccatataacattcaggaattatagatgtgtatgtatattttttaagtacagaaagttcagccagtcttcagagaagtaaaagtgatgtctattgtgcattgaagtaaatattacaaacattccagtttcgcaatacaatacttgagctttcgaacacctcagacactagaatgtgtaatgcgagtcaaaaaagctgacatacaaaacaattcccatttggctcagggttcctaaatgtcacaatatcttgggtaaaatatactttttgatttcctgatgatgtccttctaatcccttctgactttgattcctaacagccaggcactgttgacatgaatcattaacttccaaacccctttaaaatcaagaagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatgaaaaaaaaaaaagaacttttctgctaggaagattataccaccctgtggccaaacagattcatcacagataggcatctatgcccatttctctgggatctggaaaattcttcccttggctgaccccaatttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctcaaaaaaaaaaaaaagaatggattttcagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattgaaaaaaaaaaaaaaaaaa

SEQ ID NO: 272 - DNA, 2116 bp, Homo sapiens
  source (1)..(2116): /organism="Homo sapiens" /note="NR_038064" /mol_type="unassigned DNA"
ccgagggtgacactcgggcttgggacagggcgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccggtatgaattttgagtagcctttgtctactttctctccttttgtgttttgagagattaataagcataccctccctactttgattgcagagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttaaaaaaaaaaaaaaaaaaa

SEQ ID NO: 273 - DNA, 2100 bp, Homo sapiens
  source (1)..(2100): /organism="Homo sapiens" /note="NM_024556" /mol_type="unassigned DNA"
gtggtgcggggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctggaaaaaaaaaa

SEQ ID NO: 274 - DNA, 2438 bp, Homo sapiens
  source (1)..(2438): /organism="Homo sapiens" /note="NM_001199873" /mol_type="unassigned DNA"
gcctgcgggatacaacgggaatacaaaaatgcgctagagcggtccgcaacgctgtagcctgcgtaaggaacaattgatactaagtggcactaggctgcagggggtgccactgacacactgggagagggctcagccaaccacaaggtgataacgaggtcagcggagcaccagaaaccggctcactagcctcctgatcagtctcggcccagaggaaaatgaagggcttgagcttctgcttttacaaatctgaggggcaggaaatgaaatcccactagcagtctgcgtagtggagttgaaccctagcacccgctccccagggggtcgcctacaacgcgttccaggtgggcaggctcaggcgctgctccctcacaagcccccggccacgcggtgtctgggaccgggtgcctagtcagcccgggtggctccgccccgaggccccgccccatgacgcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcaaaaaaaaaaaaaaaaaaaaaaaa

SEQ ID NO: 275 - DNA, 5606 bp, Homo sapiens
  source (1)..(5606): /organism="Homo sapiens" /note="NM_006989" /mol_type="unassigned DNA"
ccagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaaaggaggagtgggctttgaacttagacatctacctcagagctcaaataggttgtttaaaatcacattcaattttcagatgaaggggaactttatagttttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtata

SEQ ID NO: 276 - DNA, 1626 bp, Homo sapiens
  source (1)..(1626): /organism="Homo sapiens" /note="NM_001257971" /mol_type="unassigned DNA"
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaa

SEQ ID NO: 277 - DNA, 2438 bp, Homo sapiens
  source (1)..(2438): /organism="Homo sapiens" /note="NM_000270" /mol_type="unassigned DNA"
ataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatttttttgtgtaacttggtatggggctggggcacagaccaagattgacatgaaaggatgtgagatcgcatgtcttgtgtgactatctgcttctcagacaagcagttaggaactgagatgagatagtatgtgagggcagcaaaggatgaagaagggcaaaatgatgaaaggtgaggtggaaagaggttatgagatggtaaagaaaagttaacttctggcacttgattgccacttctgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctctagtaatgacaacattttagttgttagtggtataatacggaagagatattttgcacaggctgctttggagaactttcaaattatcctttgtttggtaactgacctacttaactgcccaatacaaagaaaaagcaaaaaaaaaaaaaaaaaa

SEQ ID NO: 278 - DNA, 6704 bp, Homo sapiens
  source (1)..(6704): /organism="Homo sapiens" /note="NM_001130059" /mol_type="unassigned DNA"
atgacttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtgaaaaaaaaaaaaaaaaaa

SEQ ID NO: 279 - DNA, 3604 bp, Homo sapiens
  source (1)..(3604): /organism="Homo sapiens" /note="NM_003118" /mol_type="unassigned DNA"
gggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaaaaaaaaaaaaaaaa

SEQ ID NO: 280 - DNA, 5148 bp, Homo sapiens; identical to SEQ ID NO: 31
  source (1)..(5148): /organism="Homo sapiens" /note="NM_153021" /mol_type="unassigned DNA"

SEQ ID NO: 281 - DNA, 2975 bp, Homo sapiens
  source (1)..(2975): /organism="Homo sapiens" /note="NM_001170330" /mol_type="unassigned DNA"
atgaccagtctaataaatagccccattaataggagaccattacagaatgtagagggaaataataggtgccaaaggaaggcaaaaaactatggaaacaaatacttcattcactgccttgatcttgagaaaataaccctctccccaagaagaaaacatgacatagaaggtggagacaagttaaatgtgaagttttcacaattgcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttatatagctgagtttggttttattctaacaaattacctggtggtgtgattgtgaggtgattaacagttctcacatagtttactgttaggtcacacacagacttccgatcataatccatactgcctttttgagcctaaaatcagcctactaccacaattaccaaatattctgaaaatttctagtatggtgaagatggagagatcttggtgtgaaggttaattttatatgtcatcttgattatgctaggagatgcccagatttctgggtttgtccatgagggtgtttccagaagagattagcatttgaatcagtagactgaataaaaaagagccacccactccactgcgggtgggccaaccccttgagggcctagctggaataaaaaggcagaggaagggcaaattctgtcttctctctgcttgaacagggacatccatgttctatccttggacattggttctcctgattctctggctttcagacatggaccagggcccctggttctcagacctttgggtttggactggaactacaccattggctttcctgggcttactgtctgcggaaagcagattgtgggacttctcagcctccataatcacaagagccaatccctcataataaatttatttctatataaaaaaaaaaaaaaaa

SEQ ID NO: 282 - DNA, 1861 bp, Homo sapiens
  source (1)..(1861): /organism="Homo sapiens" /note="NM_002692" /mol_type="unassigned DNA"
agcctactcggtccggggttgcgaactgtaaggtctgagttgctgcggcgcaggcagcggagaccaagcagggatcttaacagggtttagcgccacgcgggccagggccgaggccggagctgggaggggcgcgcccgggaaggggcggagctgcggcggtggcgccaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggtaaactttagga

SEQ ID NO: 283 - DNA, 994 bp, Homo sapiens
  source (1)..(994): /organism="Homo sapiens" /note="NM_001192" /mol_type="unassigned DNA"
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 284 - DNA, 3116 bp, Homo sapiens
  source (1)..(3116): /organism="Homo sapiens" /note="NM_145032" /mol_type="unassigned DNA"
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcattccagcctcggcgacagagcaagactccgtctc

SEQ ID NO: 285 - DNA, 2482 bp, Homo sapiens
  source (1)..(2482): /organism="Homo sapiens" /note="NM_019091" /mol_type="unassigned DNA"
tcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaaaaaaaaaaaaaa

SEQ ID NO: 286 - DNA, 2781 bp, Homo sapiens
  source (1)..(2781): /organism="Homo sapiens" /note="NM_024956" /mol_type="unassigned DNA"
ggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaaaaaaaaaaaaaa

SEQ ID NO: 287 - DNA, 671 bp, Homo sapiens
  source (1)..(671): /organism="Homo sapiens" /note="NM_052960" /mol_type="unassigned DNA"
ggtttataggtcccggcccgagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatgaaaaaaaaaaaaaaaaa

SEQ ID NO: 288 - DNA, 2977 bp, Homo sapiens
  source (1)..(2977): /organism="Homo sapiens" /note="NM_024613" /mol_type="unassigned DNA"
gtgctcgtgcccgcgcgctcgcgcccggagtgtggacgggggcgcgcccgtgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaacttaaaaaaaaaaaaa

SEQ ID NO: 289 - DNA, 1360 bp, Homo sapiens
  source (1)..(1360): /organism="Homo sapiens" /note="NM_002923" /mol_type="unassigned DNA"
gcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacaaaaaaaaaaa

SEQ ID NO: 290 - DNA, 1688 bp, Homo sapiens
  source (1)..(1688): /organism="Homo sapiens" /note="NM_004691" /mol_type="unassigned DNA"
acttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaactgtcaaaaaaaaaaaaaaaaaa

SEQ ID NO: 291 - DNA, 1834 bp, Homo sapiens
  source (1)..(1834): /organism="Homo sapiens" /note="NM_144563" /mol_type="unassigned DNA"
cgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 292 - DNA, 1727 bp, Homo sapiens
  source (1)..(1727): /organism="Homo sapiens" /note="NM_020397" /mol_type="unassigned DNA"
agccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatgagctgagatcacaccactgcactccagcctgggtgacagattgagactccctctcaaaaaaa

SEQ ID NO: 293 - DNA, 2058 bp, Homo sapiens
  source (1)..(2058): /organism="Homo sapiens" /note="NM_016232" /mol_type="unassigned DNA"
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctc

SEQ ID NO: 294 - DNA, 1217 bp, Homo sapiens
  source (1)..(1217): /organism="Homo sapiens" /note="NM_138460" /mol_type="unassigned DNA"
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaaaaaaaaaaaaaaa

SEQ ID NO: 295 - DNA, 1491 bp, Homo sapiens
  source (1)..(1491): /organism="Homo sapiens" /note="NM_004847" /mol_type="unassigned DNA"
ggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 296 - DNA, 1172 bp, Homo sapiens
  source (1)..(1172): /organism="Homo sapiens" /note="NM_001928" /mol_type="unassigned DNA"
gtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaa

SEQ ID NO: 297 - DNA, 1379 bp, Homo sapiens
  source (1)..(1379): /organism="Homo sapiens" /note="NM_144765" /mol_type="unassigned DNA"
aacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaaaaaaaaaaa

SEQ ID NO: 298 - DNA, 2077 bp, Homo sapiens
  source (1)..(2077): /organism="Homo sapiens" /note="gi|27884043" /mol_type="unassigned DNA"
gggaaggggagcttcacagggggttttctggaagtgcccagggtgaaactgtgcttgaaggaagctcagatgtcagtttttcagattgtgctgtctgtatatctaggcattcataaatactttctagaactttgtgtagtgttttgcaaatgtagttaaacagatttgtgaattcagtaatttataaaaacttaagcttgtgttcttctgaatccctttatttttcttctgcctccgaattagacacttcccctatgcattaattccaagtacagtcaaagattaagtaaggaaatgatgtgcatgaaaaaagttctgcatgtttgctaataatctaatgactgtgacatctaaacactggaaacaccttgatttatggataatagggctatctagaattttcaagggatcatggacaaataattataggcaatttgatcaagtgaccatgtaagaccattggtgcagatacagactgattaaagtggaaaaagttcttttttcttcctagcttcctgctctgccattaccttgataatgtgagccaaggcctattggcctccacaggacaagccctaggctgtagtctgggcttgcttgaacctgcctgacctgtcacttcaaggccagccctgatcctctgagaatgggcctgggaaccatcagaaattatgtctatttgcagcaggcagggcctcttttggtctccagcatagcccttgccccatctgctcttttcactttacatggagtactaggcaaagtggcttcctctttgggttttgttacatactttaaccaagactgtgcatgcaaatggcctggcatgtactcggtgctcaggatgttgcagctactgaattattatcattgatttcttctgcgtgtgacctggatccacaagtcaaatgcaaaaatttgtcttgactgatggtcctctcctgtctccctccagtaccccctcttgaggcttgcaggggcagggaccagagggcccagcaccatgtcctgctaatgctcactcctgactgcaagggagtcagggttgggagacgctgtaacaggagaggctacagctgactgggatgcagaccgggggctgggtccttaggaaatttgttctaatcttagaaggtatgccctggcttcctgctgcagcctgaaggacaagtgtcccagacctcaggacacacacgcacacgcacactcacactgtcacttgactcctgcctgggaggcaggaatggcccctagtgaagggtacttgtgtgggcctccaggtggctgtaacataccccaggactccaggcaatcctggaaaggtggctcctggagaccaaccacccttcagactcagaggagctctctgtgaagtcaattttattattgaactaaccaacagtagagagtcagagtagtgcataacagggagattctgaacttaccttggagagtaacaaatcgtacatttacttgttggcttaggtgagtaaatccatctaaatcacccatgccagctatgaagagacacttctttcccactctttccctttgcaaaagaaaaaaaaaaaaaaaaccactcgagctgttcagaggctgccagactgacaaggttgagtttgatcggcagctctgcccctgcatgcctgctggtgggaaaaggaaagagaagacaaaaatggttgtgtgtaaccccctgaggcattgctgccttctgcctcttcatcccagcaccctctccatctcctctgcagcctttgctcaccctccctgtcttcagcctctgccatcaccttgtaatttgagccaagattcaccctcaggtttgtctgactccacaaatcccaagcaggtgcttcagggtctgccgtgggccctccactctggcaactcaccctttctgagcactcctccagtcctgctcctcccctcggctccccctctctgtaaatgacactcctctccacccagaagccagagccagaaatctgggcatcatcttgactccaccctgccccacccatcagtccccaattctggtcagtccttcctcctaaattgcttttgagtcctatca

SEQ ID NO: 299 - DNA, 1413 bp, Homo sapiens
  source (1)..(1413): /organism="Homo sapiens" /note="NM_144646" /mol_type="unassigned DNA"
ttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggactgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcataaaaa

SEQ ID NO: 300 - DNA, 879 bp, Homo sapiens
  source (1)..(879): /organism="Homo sapiens" /note="NM_139286" /mol_type="unassigned DNA"
ggagcatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttggaaaaaaaaaaaa

SEQ ID NO: 301 - DNA, 3475 bp, Homo sapiens
  source (1)..(3475): /organism="Homo sapiens" /note="NM_006241" /mol_type="unassigned DNA"
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtggcagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggttttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagagttgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaaaaaaaaaa

SEQ ID NO: 302 - DNA, 5821 bp, Homo sapiens
  source (1)..(5821): /organism="Homo sapiens" /note="NM_000564" /mol_type="unassigned DNA"
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatatcaccccatatcaaaagagacgacagattttgttcaaatattatattcttgaaggaagccttaatattctggaaatgtgctgaggaagtcattgagcataattcaatcatgaaagggaccactgaatcaagaatgaactttctgaagagatgtttgctgccaaagacttcagaacaacttgttggtcaagtaatgccagatcaatcctagtctctcaagtttggaaaagtttctacaaggccattccatcaaatatcccaatatacacagaaattcttcttcctaacatcttcatatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggaggtgctgcaatagttggcaaaatgtttaaaatgtttggtcactcaaatgattcataatctcaaacctgtttttgtttttttttttttttttttttgtggggtgggtggtggagacagtcttgttctgtctcccaggctagagtgtagtgatgtgatcttagctcactacaacctccctgtcctgggctcaagccatcctcctccctcaccctcccaagtagctgggactacaggtgcataacaccattcccagctcttttttgtatttttttttgtaaagctggggttttgccatgctgtctaggttcatctcgaactcctgggctcaagcgatacaccggcctcagccttccaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagacagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccgttatctggcccttggtatatgtgtttcaggagcaacacaaagtagcccattggcctccttggtggattgggaactccttcctcccttcttgccctgtgcaactcatagtcattctttgggaacccgtaaccatcatcacttcctccatgaagccttcaaaagcagagttggttgatcccgcctctggattctcattctgggcctcatacccgtgttagagctactgcattgtagaatataccattaacagctgggaggcctcccctctagactgcggcttccaggaggatggagcttgtgtgaaatacgtctttttatctgcagtgtctaggacagtatctgacttaagaaaatataaatgtttcttaaaccctctgtcagccctgatacggcaccttgtatataggttagactgaacagtatttggcagagatcctcaaggcctacaataatgacagggggaggaagctgggtatctaatgagaatgcggttagttagaagcaaccaggagacacatgtgcctaacaactgggctactgcaacctggatgtttttgctgccaaagtgtctaaatggttatgtataaattgctgtgtaagaggcatttcagaagtggctcactgtgagtggtctatactgttctcaccagccttgtcatagcaagtcaaagagtttgaaattcacttaacagtaaacaccatcagcagcaggttgatgtaaggtaaagtcatgatattggctcccatctcttgccatctctcactaggacgagtgtagagagtcacttttctcctagagcctccacagccacgggatcagaacaaacatgcttttccaagatatccgttccaatagggatttttagcccaatttctttccttggcatttggaattcactgcgtgcagcatgggggagtgctggggagactggagggtgaaggtcacatttgccaacagcccgaccacctgagcctcattgaaatgcctcagacctcaagctattcatgcaggctggggaagaatccacgtgggcaaagaacatcctgattaaaaatccaaacgttttcatggtgagacttctatgtgtcaggaccatctgctggtggaattaagaagcctgaggtgctaatttgttaaagaaaaagtagatatctggaagtgagaacagagaactgaaaacaatctctgatggcacaagtaaaggtgaaaaacctaattagaataggacttggtgctagcctaaggactgtagctattcctgcttctacatccttcaaattgagtaccagggtgcaaattttttcaaaaccattccttcctttggaattttgtattgtactataagacaatcatgcttatctcctgttttgtaggtaatagatgtgaatataaatatgtttcagaatgagaaatattaaacataaatgacagtgaaaaaaaaaaaaaaa

SEQ ID NO: 303 - DNA, 5273 bp, Homo sapiens
  source (1)..(5273): /organism="Homo sapiens" /note="NM_001113738" /mol_type="unassigned DNA"
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaatatctagagtaatttctgttttcctatctggggtagtgtaacataagaagaaatatatatttggtctctgcccccagttcctaacacaaagctcctaaaacccttggaaattcctgaatgatggcggtgctaagagcattgtcctttgttaatttatcatttttcttttctcctaggtgttttttcctttttaaacttttcttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctacgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactgttttcctgggttccatgagctgttctagcaaatgttcaaacctgaggagggagttgtggggacctccaatttacagccagttggtcagatgcataggtgatgcttggccttgcacctggggtctgacatgcggatggtcctgtgtgactgagcccttaacctgtggagtctggtgctcactctgcttagggcttctcttgcctttttagtgtccttctaggcggcctttccttcctcttgtcagctcagaaaacttttcttccacttcccttcttctaaaccatcccttacatctactcctttccagccgaccaagagcagaaccacggctggttccactgccaccatgctgtcccacactgtctcctcaggatgtattcagatgtccagccctccccccagtctaggagccccccctttgaggaaagggatgctggcctagtcaactctttcccagcaccaggtacagcatctggcacgttccatctttttcatggactctccccaggcggcctgaccttccctcctctgaaccggtgcatttcttgtctgcatcatgtttgccctaatcagatatcaccttatttcctcttttaaaaaatgctttgtttctctggcaggcttcatcggaatcacaattttcattcatttagtaactgttgttgtttattctatgtatttttgcaggaggcctgaggtgggctgtgttctcctcctatggcagggcttcactctcctcctcctccgttggggcttcgctgtccctgggataagaataacaatgccaaggttttcattcttgaaaggagcaattaagcttctcaccccctcctcattttagatgggaactgtgagggccccatcatttacccagggtccctgttgaggatcttgtcctcattagatgacttcttgtgcagcttccatgcatgattatttattcttgtggcactgagaggtttgtacatatctttaaaccagagcggctgtccaaatgaggaaagtccatcctagaagatagaaagggaaatattaattttgcatgtcctctgctttccctggccacagcaatgaatcctccaatgtacctgactctcccttcgcgaagagcatcccctccatggcagaaatctgaaaatgcccctggggagacacatgcacaagacagtgagtgatgcagccgtttcccacgtatctcacaatgtacttctctggtcttattaggactaaatgagtatctcagtccataatcacagggagaaccaccaccacagaccacatacccggggtcttgaaaataattccatgcatgtgggactttcagaagctctccatgtctgcccagaagggccccacaatatactggggggactttgtatgtggctcagcatggagcaggggcaggattttcagtcccactcactcccttggccaagtgcccttgtgcagtgaacaaactgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttatttttgaatttgaataaaataggaaaaggcagagtgcattgtgtgaccatggggtaagtaagacactctccctttctccttctcagttttcctgtcataaaaggacaaactactatctaaggtctccgtagttaaaattcttttttgttgttttttttttatttgagacagtttggctcattccccaggctggagtgcaatggtgctatcttggctccctgcaacctgcgcctcctgggctcaagcagttctcctgcctcagcctcccaagtagctgggattacacgcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaaaaagaaataaaagagaaaatactgtttcctgccacttaagaggaaggactcacatatcctaccttccatcagccttgaaggagacaagtgccctctctctcacacccggtggccttcccttcccctttcccagagcctccaagaaggcccctggcctggcctgatgcccaccatcagcagcaataggcaccaaaacctttctccttcctatccctccccacctcccgaaagggctggggacagcaggtgtgtccttgttagttccatccagctcagctttggctggggagctaatttcactggagccaggctaagcattagggtaagtatttgtcctgtcttgggcagtttcctcactgaaaaatgagggcagagttctaagccctcctctaattctaaaattctaattaaaacgtcgcgagactagtggtgcatgcctgtaatcccagctactcgggaggctgaggcaggagaatcgcttgaacctgggaagtggaggttgccgtgagccgagatcgtgtcattgcactccagcctggcaacaagagggaaactccgtctcaaaagagaagaaaaaaaaaatcaccagactaatatttaccttgagaatccttcttcatcttcttgtaatgaccttcggtgacaacatatctgttttagaagaaaacgcaattaagattatctatgacaacaaccaccgtctccaaatctgtattgattccttttattcattataagtctcatctacctgatgaggtaacttttttgaagacaggaattgtatgctgtgtaacactgctttgattcttccatagttcagtcatccttgctatcttgcgggggattggttctaggataccgcccccacaccataccagaatctgtggatgctcaatcccttacatataatggtgtaatatttgcttataaccaacacgcatcccccctatactttatttacttagcgacaggattgccctctgttgcttacgctggagtgcagtgtcatcctctgttactcaggatggagtgcggtgtcacgatcacagctcactgtagcctcaacctcctgggctccagtgatccgcccacctcagcctcttgagtagctgagactacaggtgcatactaccacacctggctatttttttttttaatttttaataaagacaaggtctcactatgctgcccaggttggcctcccaatgtgttgggattacaagtgtgagccaccatgcctggccccatgtaatttaagtcatcactaataaaatgtatacatattgtacattgtt

SEQ ID NO: 304 - DNA, 1396 bp, Homo sapiens
  source (1)..(1396): /organism="Homo sapiens" /note="NR_033759" /mol_type="unassigned DNA"
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacggcattggcagttctgtttggaactatctcttagagctttgtgtctgcttaaagctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctataaaaaa

SEQ ID NO: 305 - DNA, 1021 bp, Homo sapiens
  source (1)..(1021): /organism="Homo sapiens" /note="NM_176885" /mol_type="unassigned DNA"
cgaacccacctgcaggaaccaactccggacacaacaccagcattaaaacaatttttttttgtctgttcagacatgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcattg

SEQ ID NO: 306 - DNA, 495 bp, Homo sapiens
  source (1)..(495): /organism="Homo sapiens" /note="NM_001024599" /mol_type="unassigned DNA"
ggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttca

SEQ ID NO: 307 - DNA, 1309 bp, Homo sapiens
  source (1)..(1309): /organism="Homo sapiens" /note="NM_001743" /mol_type="unassigned DNA"
ctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtaaaaaaaa

SEQ ID NO: 308 - DNA, 5014 bp, Homo sapiens
  source (1)..(5014): /organism="Homo sapiens" /note="NM_019073" /mol_type="unassigned DNA"
atgacaacgagtctgcgccccgcgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatatacaaaaaaaaaa

SEQ ID NO: 309 - DNA, 363 bp, Homo sapiens
  source (1)..(363): /organism="Homo sapiens" /note="ENST00000390285" /mol_type="unassigned DNA"
atggcctgggctccactacttctcaccctcctcgctcactgcacaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctc

SEQ ID NO: 310 - DNA, 1641 bp, Homo sapiens
  source (1)..(1641): /organism="Homo sapiens" /note="NM_020362" /mol_type="unassigned DNA"
gctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaaaaaaaaaaaaaaaaaaaaa

SEQ ID NO: 311 - DNA, 453 bp, Homo sapiens
  source (1)..(453): /organism="Homo sapiens" /note="NM_181623" /mol_type="unassigned DNA"
atgtcttacaactgcagctctggaaacttctcctcctgctgttttggaagttacctgaggtatccagtttccacttataatttgttctaccccagcaatgccatctattctccaaatacctgccaactgggctcctctctctacaatggctgtcaggagacctactgtgagcccaccagctgccagacatcctgcactttggccagatcctatcagacatcctgttactgcccaaagaattccatcttctgcagtccccgccagactaactacataagatcccttggatgtggaaacactggccttggatctcttggttgtggaagcactggcttccaatctctggactgtgggtccagcttctaccacccaactaccttttcatccaggaatttccaggcaacttgttactaaccagcctttgggtctcgcctttttggatcatcttactga

SEQ ID NO: 312 - DNA, 1737 bp, Homo sapiens
  source (1)..(1737): /organism="Homo sapiens" /note="NM_006417" /mol_type="unassigned DNA"
tctttgaagcttcaaggctgctgaataatttccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggtctaaaaaaaaaaaaa

SEQ ID NO: 313 - DNA, 1067 bp, Homo sapiens
  source (1)..(1067): /organism="Homo sapiens" /note="gi|21707823" /mol_type="unassigned DNA"
agccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaaaaaaaaaa

SEQ ID NO: 314 - DNA, 1170 bp, Homo sapiens
  source (1)..(1170): /organism="Homo sapiens" /note="gi|21707823" /mol_type="unassigned DNA"
atccctttttattgctgagcagtattctatggtatgaatgtatgatggttcggacatatgggttgtttcctattttaggctgttatgaatgaagctgctctgaacattcatgtatagatttttgtgtatacaggtattttttagaaaatagagataagccaggcgtggtgatgtgtacctgtagtcccagctactctggaggctgaggcaggagaatctcttgagcccagaggttcaagatgagcctgggcaacattttggagatcctgtctccaaaaaaaaaagatggaggtagttttttgtaatggcaagattgtacattagaagatagaaaagtaggttttgcatcttactagggaagatacatgtatatttctctccctttggactgatcatttaagttgtctcaatttccttatcaagaaactggcataatatatgttctgcctacatcccagggtggttgtatagataaactgagataatatatggcctcctcccaagtagctgggattacaggtgcgtgccaccacgctgggccgatttttgtgttttcggtagagacggggtttcactgtgttggccaggctggtcttgaactcctgacctcaagtgatcctcccaccttggcctcccaaggtgctgggattgcaggcgtgagccaccgtgcccggcctcagagtagttcttaaatggtaatctagagacaactcttttaggccatcttgctttttctaataattgatgtgtagatgttccttttatattctgtttactcattgttgacgattataggttgcaatacctgctcccggatttagtttatcaccttacttttaattgaattatttgatatataagaaattccaagtccaagcatggtggctagcgcctgcaatcccagcactttgggaggccatggtgggaggatcgcttgggtccaggagtttgagaccagctgaagcaacatattgggactctgtctctaccaaaaatacaaataagttggctgggcatggtgatgcactcctataatcccagctactcaggaggctgaggtgggaggatcacttgagctctagaggccaaggctgcagtgagccgtgatcatgcctctgcaccctagtctgggtgacagaaggagaccctgtctcaaaaaaaaaaaaaaaa

SEQ ID NO: 315 - DNA, 2858 bp, Homo sapiens
  source (1)..(2858): /organism="Homo sapiens" /note="NM_003001" /mol_type="unassigned DNA"
gcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 316 - DNA, 3736 bp, Homo sapiens
  source (1)..(3736): /organism="Homo sapiens" /note="NM_152995" /mol_type="unassigned DNA"
gtcggtaaggagacgtagctttccgtggggtgtaccactgcagttggttcccggcgggagacgcaggggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaaaaaaaaaa

SEQ ID NO: 317 - DNA, 3817 bp, Homo sapiens
  source (1)..(3817): /organism="Homo sapiens" /note="NM_000170" /mol_type="unassigned DNA"
ctttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaaaaaaaaaa

SEQ ID NO: 318 - DNA, 7359 bp, Homo sapiens
  source (1)..(7359): /organism="Homo sapiens" /note="NM_001199743" /mol_type="unassigned DNA"
agccgtagacggccgagcagtggagcgaggccgcctaaaggagagccgcgctgtcgatgagtcccagtgggccacctggagcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttctgtctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggtataggttctttttatttcaataataacagaaacaactgtcaaaaccatgtgcctgtactatttggagtgctgtccttgcagaatctcattataagaaccttaggaaataggcacatcatctcctggatagaatcctaggaaatgggcactataatgggcactttatcccattttataaacatggaaattgaggcacagagagattaagtactttcccaaggtcatacagctagtgatggaggagctagcatttgaacccggagtttttagtctattgagtttaaccgacagatcatactgtgttttggtagggagggagggaggaagcaagcaagtgaacaaatgagtctgggatttaggacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattg

SEQ ID NO: 319 - DNA, 1499 bp, Homo sapiens
  source (1)..(1499): /organism="Homo sapiens" /note="NM_014736" /mol_type="unassigned DNA"
gagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaa

SEQ ID NO: 320 - protein, 858 aa, Homo sapiens [sequence omitted]

SEQ ID NO: 321 - protein, 248 aa, Homo sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPVCNLLNGTQEIGPVGMTENCDMKDFLQLKPVGLLEEHNVGEKERGQGQHQCVQLDWQKRAATGIF

SEQ ID NO: 322 - protein, 513 aa, Homo sapiens
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 323 - protein, 318 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 324 - protein, 184 aa, Homo sapiens
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 325 - protein, 161 aa, Homo sapiens
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 326 - protein, 215 aa, Homo sapiens
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLGLRDENAKGQWRWVDQTPFNPRRVFWHKNEPDNSQGENCVVLVYNQDKWAWNDVPCNFEASRICKIPGTTLN

SEQ ID NO: 327 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 328 - protein, 687 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 329 - protein, 330 aa, Homo sapiens
MSAKSRTIGIIGAPFSKGQPRGGVEEGPTVLRKAGLLEKLKEQVTQNFLILECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 330 - protein, 998 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 331 - protein, 515 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 332 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 333 - protein, 633 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 334 - protein, 440 aa, Homo sapiens
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 335 - protein, 494 aa, Homo sapiens
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 336 - protein, 675 aa, Homo sapiens
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 337 - protein, 288 aa, Homo sapiens [sequence omitted]

SEQ ID NO: 338 - protein, 1382 aa, Homo sapiens
MLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQKIVSAKSLMEFTHIIIDEVHERTEEMDFLLLVVRKLLRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKQSHEVLKGLFSKSVENMTDGSVPFPMKDDEKYLIRILLESFSTNKLGTPNCKAELHGPFNPYELKCHSLTRISKFRCVWIEKESINSVIISDAPEDLHQRMLVAASLSINATGSTMLLRETSLMPHIPGLPALLSMLFAPVIELRIDQNGKYYTGVLCGLGWNPATGASILPEHDMELAFDVQFSVEDVVEVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 339 - protein, 492 aa, Homo sapiens
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLAIQDSEVTSLIWSQGQPRSI

SEQ ID NO: 340 - protein, 390 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 341 - protein, 219 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 342 - protein, 541 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 343 - protein, 267 aa, Homo sapiens [sequence omitted]

SEQ ID NO: 344 - protein, 348 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 345 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 346 - protein, 457 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 347 - protein, 396 aa, Homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 348 - protein, 131 aa, Homo sapiens
MTHSSQDTGSCGIQEDGKLYVVDSINDLNKLNLCPAGSQHLFPLEDKIPVLGTNSGNGSRSLFFVGLLIVLIVSLALVFFVIFLIVQTGNKMDDVSRRLTAEGKDIDDLKRINNMIVKRLNQLNQLDSEQN

SEQ ID NO: 349 - protein, 1458 aa, Homo sapiens
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 350 - protein, 958 aa, Homo sapiens [sequence omitted]

SEQ ID NO: 351 - protein, 359 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 352 - protein, 473 aa, Homo sapiens
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 353 - protein, 2243 aa, Homo sapiens
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLATPPNGNFADAVFRFNANISYSGVLHAVTQDGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNGRTLFKLFQHPSMAIIKGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAKEVEKFAKEKVDLVLMHWRDRMGIAQKENINQKPVVLRKRRQRIKIEANWDLFYYRFGQDHARSNLIWNFKTREELKDTLESEMRAFNIDRELGSANVISWNHHEFEVKYECLAEEIKIGDYYLRLLLEEDENEESGSIKRSYEFFNELYHRFLLTPKVNMKCLCLQALAIVYGRCHEEIGPFTDTRYIIGMLERCTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 354 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 355 - protein, 417 aa, Homo sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPRPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRICPRPRGATATCSSDHQACCIPRPLPLCCKCPPPPLLGQFCSNSSSIRRRTAPTAALPPRARCWAGTCRPRRPC

SEQ ID NO: 356 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 357 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 358 - protein, 232 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 359 - protein, 132 aa, Homo sapiens
MDLPYYHGRLTKQDCETLLLKEGVDGNFLLRDSESIPGVLCLCVSFKNIVYTYRIFREKHGYYRIQTAEGSPKQVFPSLKELISKFEKPNQGMVVHLLKPIKRTSPSLRWRGLKLELETFVNSNSDYVDVLP

SEQ ID NO: 360 - protein, 514 aa, Homo sapiens
MDEGMEISSEGNSLIKAVHQSRLRLTRLLLEGGAYINESNDRGETPLMIACKTKHVDHQSVSKAKMVKYLLENNADPNIQDKSGKTALMHACLEKAGPEVVSLLLKSGADLSLQDHSSYSALVYAINSEDTETLKVLLSACKAKGKEVIIITTAKLPCGKHTTKQYLNMPPVDIDGCHSPATCTTPSEIDIKTASSPLSHSSETELTLFGFKDLELAGSNDDTWDPGSPVRKPALAPKGPKLPHAPPWVKSPPLLMHQNRVASLQEELQDITPEEELSYKTNGLALSKRFITRHQSIDVKDTAHLLRAFDQASSRKMSYDEINCQSYLSEGNQQCIEVPVDQDPDSNQTIFASTLRSIVQKRNLGANHYSSDSQLSAGLTPPTSEDGKALIGKKKILSPSPSQLSESKELLENIPPGPLSRRNHAVLERRGSGAFPLDHSVTQTRQGFLPPLNVNSHPPISDINVNNKICSLLSCGQKVLMPTVPIFPKEFKSKKMLLRRQSLQTEQIKQLVNF

SEQ ID NO: 361 - protein, 365 aa, Homo sapiens
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWITQWLFLRYKSIVGRRFCFIIGTLYLYRCITMYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEKNLKVSSQTNFLSRAWWFPIFYFFEKNVQGSIPCCFSWPLSWPPGCFKSSCKKYSRVQKIGEDNEKST

SEQ ID NO: 362 - protein, 378 aa, Homo sapiens
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 363 - protein, 505 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTNNFPKNQTPVRMRRNSFTPLSSSNTIRRPRNYSVGSRPLKPLSPLRAQDMQEGAD

SEQ ID NO: 364 - protein, 645 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 365 - protein, 244 aa, Homo sapiens
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 366 - protein, 103 aa, Homo sapiens [sequence omitted]

SEQ ID NO: 367 - protein, 222 aa, Homo sapiens
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLK

SEQ ID NO: 368 - protein, 136 aa, Homo sapiens
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 369 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 370 - protein, 811 aa, Homo sapiens
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 371 - protein, 117 aa, Homo sapiens
MGSQVAFLPPPPARSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 372 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 373 - protein, 77 aa, Homo sapiens
MPKCPKCNKEVYFAERVTSLGKDWHRPCLKCEKCGKTLTSGGHAEHEGKPYCNHPCYAAMFGPKGFGRGGAESHTFK

SEQ ID NO: 374 - protein, 708 aa, Homo sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 375 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 376 - protein, 116 aa, Homo sapiens
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 377 - protein, 453 aa, Homo sapiens
MALVRALVCCLLTAWHCRSGLGLPVAPAGGRNPPPAIGQFWHVTDLHLDPTYHITDDHTKVCASSKGANASNPGPFGDVLCDSPYQLILSAFDFIKNSGQEASFMIWTGDSPPHVPVPELSTDTVINVITNMTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 378 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 379 - protein, 311 aa, Homo sapiens
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 380 - protein, 137 aa, Homo sapiens [sequence omitted]

SEQ ID NO: 381 - protein, 542 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 382 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 383 - protein, 786 aa, Homo sapiens
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASGQGVPLISVTTLRRGGYSTLPNPQKSEWIYDTPVSPGKASVRNTPLTSFAEESRPHALPSSSSTFYNPPSGRSRSLTPQLNNNVPMQKKLSLPEIPSYGFLVPRGTFPLDEDVSYKVPSSFLIPRVEQQNTKPNIYDIPKATSSVSQAGKELEKAKEVSENSAGHNSSWFSRRTTSPSPEPDRLSGSSSDSRASIVSSCSTTSTDDSSSSSSEESAKELSLDLDVAKETVMALQHKVVSSVAGLMLFVSRKWRFRDYLEANIDAIHRSTDHIEESVREFLDFARGVHGTACNLTDSNLQNRIRDQMQTISNSYRILLETKESLDNRNWPLEVLVTDSVQNSPDDLERFVMVARMLPEDIKRFASIVIANGRLLFKRNCEKEETVQLTPNAEFKCEKYIQPPQRETESHQKSTPSTKQREDEHSSELLKKNRANICGQNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 384 - protein, 404 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 385 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 386 - protein, 2732 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELRNRDTRHSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 387 - protein, 539 aa, Homo sapiens
MDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 388 - protein, 115 aa, Homo sapiens
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 389 - protein, 156 aa, Homo sapiens
MITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 390 - protein, 543 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 391 - protein, 362 aa, Homo sapiens [sequence omitted]

SEQ ID NO: 392 - protein, 285 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 393 - protein, 216 aa, Homo sapiens
MGWIRGRRSRHSWEMSEFHNYNLDLKKSDFSTRWQKQRCPVVKSKCRENASPFFFCCFIAVAMGIRFIIMVTIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 394 - protein, 1226 aa, Homo sapiens
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSMSNKLSNGHAVCLIENPTEENRHRISKYSQTESQQIRYFTHHSVKYFWNDTIHNFDFLKGLDEGVSCTSIYEKHSAGLTKGMHAYRKLLYGVNEIAVKVPSVFKLLIKEVLNPFYIFQLFSVILWSTDEYYYYALAIVVMSIVSIVSSLYSIRKQYVMLHDMVATHSTVRVSVCRVNEEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVEESVDRWGKCCLPWALGCRKKTPKAKYMYLAQELLVDPEWPPKPQTTTEAKALVKENGSCQIITIT

SEQ ID NO: 395 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 396 - protein, 54 aa, Homo sapiens
MPGKKARKNAQPSPARAPAELEVECATQLRRFGDKLNFRQKLLNLISKLFCSGT

SEQ ID NO: 397 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 398 - protein, 335 aa, Homo sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 399 - protein, 103 aa, Homo sapiens [sequence omitted]

SEQ ID NO: 400 - protein, 266 aa, Homo sapiens [sequence omitted]

SEQ ID NO: 401 - protein, 223 aa, Homo sapiens
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 402 - protein, 622 aa, Homo sapiens
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 403 - protein, 345 aa, Homo sapiens
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSKI

SEQ ID NO: 404 - protein, 487 aa, Homo sapiens
MRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 405 - protein, 303 aa, Homo sapiens
MAAVAVLRAFGASGPMCLRRGPWAQLPARFCSRDPAGAGRRESEPRPTSARQLDGIRNIVLSNPKKRNALSLAMLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 406 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 407 - protein, 172 aa, Homo sapiens
MAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRVEILCEHPRFRVFVDGHQLFDFYHRIQTLSAIDTIKINGDLQITKLG

SEQ ID NO: 408 - protein, 318 aa, Homo sapiens
MERGDQPKRTRNENIFNCLYKNPEATFKLICFPWMGGGSTHFAKWGQDTHDLLEETASHHVAKAGLKLRRSSDPPASAYPCAGVSHRRREPPCLAKILGLFWILIFFMHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 409 - protein, 486 aa, Homo sapiens
MSSSSPPAGAASAAISASEKVDGFTRKSVRKAQRQKRSQGSSQFRSQGSQAELHPLPQLKDATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 410 - protein, 882 aa, Homo sapiens
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 411 - protein, 598 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 412 - protein, 551 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 413 - protein, 1093 aa, Homo sapiens
MSQPGIPASGGAPASLQAQNGAALASGSPYTNGPVQNALLSSQESVSQGYNFQLPGSYPHPIPAKTLNPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 414 - protein, 911 aa, Homo sapiens
MPPRRSIVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNLEGWWKIRYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEVIEKNLSGWWYIQIEDKEGWAPATFIDKYKKTSNASRPNFLAPLPHEVTQLRLGEAAALENNTGSEATGPSRPLPDAPHGVMDSGLPWSKDWKGSKDVLRKASSDMSASAGYEEISDPDMEEKPSLPPRKESIIKSEGELLERERERQRTEQLRGPTPKPPGVILPMMPAKHIPPARDSRRPEPKPDKSRLFQLKNDMGLECGHKVLAKEVKKPNLRPISKSKTDLPEEKPDATPQNPFLKSRPQVRPKPAPSPKTEPPQGEDQVDICNLRSKLRPAKSQDKSLLDGEGPQAVGGQDVAFSRSFLPGEGPGRAQDRTGKQDGLSPKEISCRAPPRPAKTTDPVSKSVPVPLQEAPQQRPVVPPRRPPPPKKTSSSSRPLPEVRGPQCEGHESRAAPTPGRALLVPPKAKPFLSNSLGGQDDTRGKGSLGPWGTGKIGENREKAAAASVPNADGLKDSLYVAVADFEGDKDTSSFQEGTVFEVREKNSSGWWFCQVLSGAPSWEGWIPSNYLRKKP

SEQ ID NO: 415 - protein, 209 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 416 - protein, 179 aa, Homo sapiens
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 417 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 418 - protein, 597 aa, Homo sapiens
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 419 - protein, 307 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 420 - protein, 300 aa, Homo sapiens
MAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKLKYDEKIKNIREEAERNIFKDVFNRIWKMLSEIWHRFLSKCKFYSS

SEQ ID NO: 421 - protein, 84 aa, Homo sapiens
MKVKIKCWNGVATWLWVANDENCGICRMAFNGCCPDCKVPGDDCPLVWGQCSHCFHMHCILKWLHAQQVQQHCPMCRQEWKFKE

SEQ ID NO: 422 - protein, 245 aa, Homo sapiens
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 423 - protein, 99 aa, Homo sapiens
MRNSRDIQNKLLRCVVICLKSDGKREIIKFNFIIHRAANHWCSGRICYTTLGRILWYNVSLKTLKYGNGLCMFSLHIILFSCLPPFCFFLFSFVLRVPA

SEQ ID NO: 424 - protein, 178 aa, Homo sapiens
MPRLHDHFWSCSCAHSARRRGPPRASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 425 - protein, 104 aa, Homo sapiens
MAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCL

SEQ ID NO: 426 - protein, 521 aa, Homo sapiens
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 427 - protein, 148 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 428 - protein, 103 aa, Homo sapiens [sequence omitted]

SEQ ID NO: 429 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 430 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 431 - protein, 370 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 432 - protein, 254 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 433 - protein, 1156 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 434 - protein, 330 aa, Homo sapiens
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 435 - protein, 292 aa, Homo sapiens
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 436 - protein, 207 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 437 - protein, 182 aa, Homo sapiens
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGLFSGELPECTQELMIDVTKSYYQKFLPLTQV

SEQ ID NO: 438 - protein, 260 aa, Homo sapiens
MGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQSRQKDRQKEMDNFLAQMEAKYCKSSKGGGKKSALKKEKK

SEQ ID NO: 439 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 440 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 441 - protein, 132 aa, Homo sapiens
MTGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 442 - protein, 488 aa, Homo sapiens
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 443 - protein, 1082 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 444 - protein, 5058 aa, Homo sapiens
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNKDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 445 - protein, 161 aa, Homo sapiens
MSSHLPFYVTCARWLLCLQTSHLHSRQKGEGKSKRCVPNKSILKTNKGRGSRRKFKKKKKKNKNRKAVVSLKAPSSRLLPVTHYPVMWPRLDSRQSEEVSVSKRHMDATDKIKFPWLKEKRTIEFGEAAGYVCHRRYKDMEPHEKMGEAAKKVHWVQMRSR

SEQ ID NO: 446 - protein, 131 aa, Homo sapiens
MSGRGKQGGKARAKSKSRSSRAGLQFPVGRIHRLLRKGNYAERIGAGAPVYLAAVLEYLTAEILELAGNASRDNKKTRIIPRHLQLAIRNDEELNKLLGGVTIAQGGVLPNIQAVLLPKKTESHHHKAQSK

SEQ ID NO: 447 - protein, 136 aa, Homo sapiens; identical to SEQ ID NO: 368

SEQ ID NO: 448 - protein, 146 aa, Homo sapiens [sequence omitted]

SEQ ID NO: 449 - protein, 220 aa, Homo sapiens
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 450 - protein, 147 aa, Homo sapiens
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 451 - protein, 334 aa, Homo sapiens
MLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 452 - protein, 725 aa, Homo sapiens
MGAASVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 453 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 454 - protein, 238 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 455 - protein, 415 aa, Homo sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 456 - protein, 676 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 457 - protein, 356 aa, Homo sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 458 - protein, 136 aa, Homo sapiens; identical to SEQ ID NO: 368

SEQ ID NO: 459 - protein, 170 aa, Homo sapiens
MALLLSDWCPDGDADTHTGTDPGRTTHRLCARERGVRGTQPCPRIYLRLPAQNCEETRFCCASPGSVVLGHGAPRTASPPSALSHPSPLEGLSFSPFPPSVLSHPSPPEGLSFSLFHCLCSGKLSESPGCFWNSLGWSFSVLTEPGVWKVGEAIWVAENLAQPLTSPCAC

SEQ ID NO: 460 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 461 - protein, 172 aa, Homo sapiens
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 462 - protein, 444 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKIIKWATDDIKSQLHLLWIYTAR

SEQ ID NO: 463 - protein, 3256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 464 - protein, 550 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 465 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 466 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 467 - protein, 1068 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 468 - protein, 710 aa, Homo sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 469 - protein, 311 aa, Homo sapiens
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 470 - protein, 241 aa, Homo sapiens
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 471 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 472 - protein, 349 aa, Homo sapiens
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 473 - protein, 237 aa, Homo sapiens
MTSEITYAEVRFKNEFKSSGINTASSAASKERTAPHKSNTGFPKLLCASLLIFFLLLAISFFIAFVIFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 474 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 475 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 476 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 477 - protein, 347 aa, Homo sapiens
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 478 - protein, 269 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 479 - protein, 568 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 480 - protein, 337 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 481 - protein, 88 aa, Homo sapiens
MHFILFSVSLKFSIFYLFFSVPNVHPFCSFFNCSCPSLWISVSQTSLQFSRCYDKPWLVNSKAGTPIRDSHSPDLQLPTPEVEYGFAD

SEQ ID NO: 482 - protein, 643 aa, Homo sapiens
MPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 483 - protein, 184 aa, Homo sapiens [sequence omitted]

SEQ ID NO: 484 - protein, 1338 aa, Homo sapiens
MASPPRHGPPGPASGDGPNLNNNNNNNNHSVRKCGYLRKQKHGHKRFFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIDFLSHHLKEATIVKE

SEQ ID NO: 485 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 486 - protein, 356 aa, Homo sapiens; identical to SEQ ID NO: 457

SEQ ID NO: 487 - protein, 571 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 488 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 489 - protein, 622 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 490 - protein, 310 aa, Homo sapiens
MMDNHSSATEFHLLGFPGSQGLHHILFAIFFFFYLVTLMGNTVIIVIVCVDKRLQSPMYFFLSHLSTLEILVTTIIVPMMLWGLLFLGCRQYLSLHVSLNFSCGTMEFALLGVMAVDRYVAVCNPLRYNIIMNSSTCIWVVIVSWVFGFLSEIWPIYATFQFTFRKSNSLDHFYCDRGQLLKLSCDNTLLTEFILFLMAVFILIGSLIPTIVSYTYIISTILKIPSASGRRKAFSTFASHFTCVVIGYGSCLFLYVKPKQTQGVEYNKIVSLLVSVLTPFLNPFIFTLRNDKVKEALRDGMKRCCQLLKD

SEQ ID NO: 491 - protein, 208 aa, Homo sapiens
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPFSALLLLCNQLLLCSDDT

SEQ ID NO: 492 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 493 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 494 - protein, 640 aa, Homo sapiens
MDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQRELRSALDKTEELEVSNGHLVKRLEKMKANRSALLSQQ

SEQ ID NO: 495 - protein, 1210 aa, Homo sapiens
SNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 496 - protein, 76 aa, Homo sapiens
MPVAPSNHCDNQCPHIFSKALVVSVAPSPPRDKPAPYTFTDVSSLCGLQKKCEGGKAMLFTLKRDRFSFLLFVSHC

SEQ ID NO: 497 - protein, 1032 aa, Homo sapiens [sequence omitted]

SEQ ID NO: 498 - protein, 144 aa, Homo sapiens
MPKNKGKGGKNRRRGKNENESEKRELVFKEDGQEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 499 - protein, 136 aa, Homo sapiens
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 500 - protein, 82 aa, Homo sapiens
MAVFHDEVEIEDFQYDEDSETYFYPCPCGDNFSITKEDLENGEDVATCPSCSLIIKVIYDKDQFVCGETVPAPSANKELVKC

SEQ ID NO: 501 - protein, 290 aa, Homo sapiens
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 502 - protein, 299 aa, Homo sapiens
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 503 - protein, 1682 aa, Homo sapiens
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 504 - protein, 487 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 505 - protein, 475 aa, Homo sapiens [sequence omitted]

SEQ ID NO: 506 - protein, 718 aa, Homo sapiens
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 507 - protein, 87 aa, Homo sapiens
MSEWGNLDMDFSLPELRADQRLCLNFQDPFLPLVDAHGIEKCRAFSFSVEKFCLPLVMKGILQKGVSPLNSSTDYGRLAKKREFMNP

SEQ ID NO: 508 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 509 - protein, 124 aa, Homo sapiens
MADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 510 - protein, 534 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 511 - protein, 183 aa, Homo sapiens
MEVKFITGKHGGRRPQRAEPQRICRALWLTPWPSLILKLLSWIILSNLFLHLRATHHMTELPLRFLYIALSEMTFREQTSHQIIQQMSLSNKLEQNQLYGEVINKETDNPVISSGLTLLFAQKPQSPGWKNMSSTKRVCTILADSCRAQAHAADRGERGHFGVQILHHFIEVFNVMAVRSNPF

SEQ ID NO: 512 - protein, 657 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 513 - protein, 755 aa, Homo sapiens
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 514 - protein, 1053 aa, Homo sapiens
MAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 515 - protein, 201 aa, Homo sapiens
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 516 - protein, 572 aa, Homo sapiens
MPVYCKYQFHKTPVHKTKGEPHGTHVYFQDINVIFLGALHPSDLREYLEGPPMVVEVHDRDRKSEECSQKPVLFGEDPLDSYLNFQALISPRETENNPFESQNKMWYPYGIAQVSFADLLLGHKYLNLAVPIHSCEVQPTHCGQDSRRRKVVGLGVPRDGHQHGPMPRGNYLEADSQLKLRVDIAVPLRAGARAADPDLGGSQFGRIIFVFDFKKVSLLHSLLQDITMINAKALGLDSYPVRTLQQILSAFKVRVRVQEQQHLDVLTGFHLLDGKTHLFILEGLADQGLRQLWENHQSWIPRSEHRKYKVLYNSQLLFRSRLYGDLEAILYHVHLFQPTELLLQQAVFFLRDTERRRVFQALARIHDICYNSTTLWDVTVRDLLPSSAMIKDLSQEFGMPLSQEELTDEKLFALPPQPAPNLEDYHSRNSTLTLEIHAHQEPRKRFTYSQDYLSAMVEPLDLKEEEKKAQKKSRQAWLTARGFQVTGLQSDTESSFQDLKLPPIKELNEEWKENSLFANVLEPVLDRDRWSWDRHHVDFDLYKKPPPFLELLPSPAPKPVTVRKKKGNSPIS

SEQ ID NO: 517 - protein, 152 aa, Homo sapiens
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 518 - protein, 1132 aa, Homo sapiens
MQRRGAGLGWPRQQQQQPPPLAVGPRAAAMVPSGGVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 519 - protein, 205 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 520 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 521 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 522 - protein, 1015 aa, Homo sapiens
MDIMSAQASSGSTSVLRWVLSCLATLLRKQDLEAWGYPVTLQVYHGLLSFTVHPKPKLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 523 - protein, 511 aa, Homo sapiens
MSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTVDSNSELSNEELRQCLNETLEEVEMLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLELAVLGACLCHGPGGNPCSCARMAASTRKLLLQLKQELEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRKTSEFSVLGDPIHSSVCILNSVGCICSIQHSQIDPNYRTLKRSHSLPSSIIF

SEQ ID NO: 524 - protein, 126 aa, Homo sapiens
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 525 - protein, 411 aa, Homo sapiens
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 526 - protein, 668 aa, Homo sapiens
MLGTQGWTKQRKPCPQNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 527 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 528 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 529 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 530 - protein, 200 aa, Homo sapiens
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 531 - protein, 286 aa, Homo sapiens
MSPHPTALLGLVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 532 - protein, 136 aa, Homo sapiens; identical to SEQ ID NO: 368

SEQ ID NO: 533 - protein, 90 aa, Homo sapiens
MDPLRAQQLAAELEVEMMADMYNRMTSACHRKCVPPHYKEAELSKGESVCLDRCVSKYLDIHERMGKKLTELSMQDEELMKRVQQSSGPA

SEQ ID NO: 534 - protein, 498 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 535 - protein, 128 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKTK

SEQ ID NO: 536 - protein, 599 aa, Homo sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 537 - protein, 185 aa, Homo sapiens
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 538 - protein, 357 aa, Homo sapiens
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMDRGAMVLTTNYDNLLEAFGRRQNKPMESLDLKDKTKVLEWARGHMKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 539 - protein, 136 aa, Homo sapiens; identical to SEQ ID NO: 368

SEQ ID NO: 540 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 541 - protein, 223 aa, Homo sapiens
MQQRGAAGSRGCALFPLLGVLFFQDAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 542 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 543 - protein, 253 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 544 - protein, 136 aa, Homo sapiens; identical to SEQ ID NO: 368

SEQ ID NO: 545 - protein, 145 aa, Homo sapiens
MDSQKEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKVHKNCINTLNKGSCIFKKAFLFFFSFGFLY

SEQ ID NO: 546 - protein, 210 aa, Homo sapiens
MLKCFRNCLRPSSLSTLPLQYGILFPKLLACLVHLHFGHFSSAVISVTSFYLSMNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 547 - protein, 747 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 548 - protein, 92 aa, Homo sapiens
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 549 - protein, 575 aa, Homo sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 550 - protein, 492 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 551 - protein, 1013 aa, Homo sapiens
MAEPGHSHHLSARVRGRTERRIPRLWRLLLWAGTAFQVTQGTGPELHACKESEYHYEYTACDSTGSRWRVAVPHTPGLCTSLPDPVKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 552 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 553 - protein, 279 aa, Homo sapiens
MFRAPCHRLRARGTRKARAGAWRGCTFPCLGKGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 554 - protein, 132 aa, Homo sapiens
MAFDSTWKVDRSENYDKFMEKMGVNIVKRKLAAHDNLKLTITQEGNKFTVKESSTFRNIEVVFELGVTFNYNLADGTELRGTWSLEGNKLIGKFKRTDNGNELNTVREIIGDELVQTYVYEGVEAKRIFKKD

SEQ ID NO: 555 - protein, 1458 aa, Homo sapiens; identical to SEQ ID NO: 349

SEQ ID NO: 556 - protein, 117 aa, Homo sapiens
MDMRVPAQLLGLLLLWLSGARCDIQMTQSPSSLSASVGDRVTITCQASQDISNYLNWYQQKPGKAPKLLIYDASNLETGVPSRFSGSGSGTDFTFTISSLQPEDIATYYCQQYDNLP

SEQ ID NO: 557 - protein, 172 aa, Homo sapiens
MSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 558 - protein, 1013 aa, Homo sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 559 - protein, 339 aa, Homo sapiens
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 560 - protein, 142 aa, Homo sapiens
MSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 561 - protein, 520 aa, Homo sapiens
MPQLSLSSLGLWPMAASPWLLLLLVGASWLLARILAWTYTFYDNCCRLRCFPQPPKRNWFLGHLGLVTPTEQGMRVLTQLVATYPQGFKVWMGPIFPVIRFCHPNIIRSVINASAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 562 - protein, 806 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 563 - protein, 2426 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLRNGALTRPNCMFFLNRY

SEQ ID NO: 564 - protein, 325 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 565 - protein, 6907 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 566 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 567 - protein, 394 aa, Homo sapiens
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 568 - protein, 97 aa, Homo sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 569 - protein, 1026 aa, Homo sapiens
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 570 - protein, 42 aa, Homo sapiens
MCDRKAVIKNADMSEEMQQDSVECATQALEKYNIEKDIAAHI

SEQ ID NO: 571 - protein, 57 aa, Homo sapiens
MLERWFFECSVKLALGHMAASINLYATFIKHECHEPTLRDLIIWRVRSDPQISSISW

SEQ ID NO: 572 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 573 - protein, 443 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 574 - protein, 1034 aa, Homo sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 575 - protein, 351 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 576 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 577 - protein, 803 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 578 - protein, 333 aa, Homo sapiens [sequence omitted]

SEQ ID NO: 579 - protein, 289 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 580 - protein, 494 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 581 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 582 - protein, 1458 aa, Homo sapiens; identical to SEQ ID NO: 349

SEQ ID NO: 583 - protein, 199 aa, Homo sapiens
MTSLINSPINRRPLQNVEGNNRCQRKAKNYGNKYFIHCLDLEKITLSPRRKHDIEGGDKLNVKFSQLRSRRQRKAEPGACALGRVGSECIPEPGARRTAQAAGLRSVSGAANTKVRELKHFRFLGLLRSCRSEMEVDAPGVDGRDGLRERRGFSEGGRQNFDVRPQSGANGLPKHSYWLDLWLFILFDVVVFLFVYFLP

SEQ ID NO: 584 - protein, 527 aa, Homo sapiens
MAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPGSFPRSGFSFKVFYPSNKTVEDSKLQGF

SEQ ID NO: 585 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 586 - protein, 735 aa, Homo sapiens
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 587 - protein, 300 aa, Homo sapiens
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDRPVHCSKNTLNGDLASATIPEESRLMAKKQSESEDTLPSFSS

SEQ ID NO: 588 - protein, 643 aa, Homo sapiens
MAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 589 - protein, 134 aa, Homo sapiens
MPADLSGTWTLLSSDNFEGYMLALGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 590 - protein, 249 aa, Homo sapiens
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 591 - protein, 211 aa, Homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 592 - protein, 351 aa, Homo sapiens
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 593 - protein, 311 aa, Homo sapiens
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 594 - protein, 357 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 595 - protein, 556 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 596 - protein, 156 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 597 - protein, 161 aa, Homo sapiens
GRKASEKTGGREGEPADRGLQLGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 598 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 599 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 600 - protein, 147 aa, Homo sapiens
MPAMKRHFFPTLSLCKRKKKKKPLELFRGCQTDKVEFDRQLCPCMPAGGKRKEKTKMVVCNPLRHCCLLPLHPSTLSISSAAFAHPPCLQPLPSPCNLSQDSPSGLSDSTNPKQVLQGLPWALHSGNSPFLSTPPVLLLPSAPPLCK

SEQ ID NO: 601 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 602 - protein, 85 aa, Homo sapiens
MLRRKPTRLELKLDDIEEFENIRKDLETRKKQKEDVEVVGGSDGEGAIGLSSDPKSREQMINDRIGYKPQPKPNNRSSQFGSLEF

SEQ ID NO: 603 - protein, 205 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 604 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 605 - protein, 177 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVK

SEQ ID NO: 606 - protein, 309 aa, Homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 607 - protein, 126 aa, Homo sapiens
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 608 - protein, 149 aa, Homo sapiens [sequence omitted]

SEQ ID NO: 609 - protein, 488 aa, Homo sapiens
MPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 610 - protein, 121 aa, Homo sapiens
MAWAPLLLTLLAHCTGSWANFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHTVL

SEQ ID NO: 611 - protein, 211 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 612 - protein, 137 aa, Homo sapiens
MSYNCSSGNFSSCCFGSYLRYPVSTYNLFYPSNAIYSPNTCQLGSSLYNGCQETYCEPTSCQTSCTLARSYQTSCYCPKNSIFCSPRQTNYIRSLGCGNTGLGSLGCGSTGFQSLDCGSSFYHPTTFSSRNFQATCY

SEQ ID NO: 613 - protein, 444 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 614 - protein, 214 aa, Homo sapiens
MRPKTGQVGCETPEELGPGPRQRWPLLLLGLAMVAHGLLRPMVAPQSGDPDPGASVGSSRSSLRSLWGRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 615 - protein, 169 aa, Homo sapiens
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 616 - protein, 911 aa, Homo sapiens
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 617 - protein, 1020 aa, Homo sapiens
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 618 - protein, 152 aa, Homo sapiens
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPAP

SEQ ID NO: 619 - protein, 111 aa, Homo sapiens
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKACPLQPDHTNDEKE

The invention claimed is:

1. A composition comprising a mixture of a DNA polymerase, sample peripheral blood leukocyte cDNA having a cDNA expression profile characteristic of a subject with a clinical sign of systemic inflammatory response syndrome (SIRS), wherein the sample cDNA expression profile comprises granulysin (GNLY) cDNA at a lower level than a control cDNA expression profile characteristic of a healthy subject, and each of arginase 1 (ARG1) cDNA, toll-like receptor 5 (TLR5) cDNA, vanin 1 (VNN1) cDNA, and matrix metalloproteinase 9 (MMP9) cDNA at a higher level than the control cDNA expression profile, wherein the sample peripheral blood leukocyte cDNA comprises a complement component 3a receptor 1 (C3AR1) cDNA and a human leukocyte antigen DP beta 1 (HLA-DPB1) cDNA, and for each of the C3AR1 cDNA and the HLA-DPB1 cDNA, two oligonucleotide primers that hybridize to opposite complementary strands of the cDNA.

* * * * *